US009085641B2

(12) United States Patent
Schmetzer et al.

(10) Patent No.: US 9,085,641 B2
(45) Date of Patent: Jul. 21, 2015

(54) PEPTIDES REGULATING THE SURFACE EXPRESSION OF THE T CELL RECEPTOR

(75) Inventors: Oliver Schmetzer, Berlin (DE); Antonio Pezzutto, Berlin (DE)

(73) Assignee: Max-Delbruck-Centrum Fur Molekulare Medizin, Berlin (DE)

( * ) Notice: Subject to any disclaimer, the term of this patent is extended or adjusted under 35 U.S.C. 154(b) by 466 days.

(21) Appl. No.: 12/306,176

(22) PCT Filed: Jun. 23, 2007

(86) PCT No.: PCT/EP2007/005553
§ 371 (c)(1),
(2), (4) Date: Mar. 5, 2009

(87) PCT Pub. No.: WO2007/147630
PCT Pub. Date: Dec. 27, 2007

(65) Prior Publication Data

US 2010/0291120 A1 Nov. 18, 2010

(30) Foreign Application Priority Data

Jun. 23, 2006 (EP) .................................... 06013025

(51) Int. Cl.

| | |
|---|---|
| ***C07K 14/725*** | (2006.01) |
| ***A61K 38/00*** | (2006.01) |
| ***A61K 39/39*** | (2006.01) |
| *C07H 21/04* | (2006.01) |

(52) U.S. Cl.
CPC ............ *C07K 14/7051* (2013.01); *A61K 38/00* (2013.01); *A61K 39/39* (2013.01)

(58) Field of Classification Search
None
See application file for complete search history.

(56) References Cited

U.S. PATENT DOCUMENTS 6,197,531 B1 3/2001 Lieberman

FOREIGN PATENT DOCUMENTS

WO WO9622306 A 7/1996
WO WO2005115430 A 12/2005

OTHER PUBLICATIONS

Campbell, A.M. Monoclonal antibody technology, Elsevier Science Publishing Co., Inc., NY, NY, USA, pp. 1-33, 1984.*
Ngo et al. The Protein Folding Problem and Tertiary Structure Prediction, Merz & LeGrand, Birkhauser Boston, pp. 491-495, 1994.*
Hoyer et al (Blood. 2009;113:389-395).*
Zeng et al (J. Clin. Invest. 112:1211-1222, 2003).*
Belkaide and Rouse (Nature Immunol. 6(4): 353-360, 2005).*
Leavy (Nature Reviews: Immunology, 7: 322-323, 2007).*
Reverso (English Definition dictionary/Reverso, 2015, worldwideweb at dictionary.reverso.net).*
UniProt P04234 (2015).*
Database EMBL [Online]; May 25, 1997, "zw70a10.sl Soares_testis-NHT *Homo sapiens* cDNA clone IMAGE:781530 3' similar to gb:X01451_cds1 T-Cell Surface Glycoprotein CD3 Delta Chain Precursor (Human);, mRNA sequence." ; XP02396085 ; retrieved from EBI accession No. EM_EST:AA431288 ; Database accession No. AA431288.
Database EMBL [Online]; Oct. 28, 1998, "qg82f07.x1 Soares_NFL_T_GBC_S1 *Homo sapiens* cDNA clone IMAGE: 1841701 3' similar to gb:X01451_cds1 T-Cell Surface Glycoprotein CD3 Delta Chain Precursor (Human);, mRNA sequence." XP002396086 retrieved from EBI accession No. EM_EST:AI219691 ; Database accession No. AI219691.
Call, Matthew E et al., "The T cell receptor: Critical role of the membrane environment in receptor assembly and function," Ann. Rev. Immunol. 2005, 23:101-125, XP002396081, ISSN: 0732-0582.
Kuhns, Michael S et al., "Deconstructing the form and function of the TCR/CD3 complex," Immunity 2006, 24 (2):133-139, XP002396082, ISSN: 1074-7613.
International Search Report and Written Opinion mailed Dec. 18, 2007 for PCT Application No. PCT/EP2007/005553.

* cited by examiner

*Primary Examiner* — Gerald R Ewoldt
*Assistant Examiner* — Marianne Dibrino
(74) *Attorney, Agent, or Firm* — Faegre Baker Daniels LLP

(57) ABSTRACT

The present invention is related to a peptide comprising an amino acid sequence according to SEQ. ID. No 1.

5 Claims, 12 Drawing Sheets

PEPTIDES REGULATING THE SURFACE EXPRESSION OF THE T CELL RECEPTOR

CROSS REFERENCE TO RELATED APPLICATIONS

This application is a U.S. national stage entry of PCT/EP2007/05553, filed Jun. 23, 2007, which claims priority to European Patent Application No. EP 060 13025.9 filed on Jun. 23, 2006, which is incorporated herein by reference in its entirety.

FIELD

The present invention is related to peptides regulating the surface expression of the T cell receptor as well as cytokine receptors, nucleic acids coding therefor and agents interacting therewith and uses thereof

BACKGROUND

To date, immune-related diseases such as, in particular, infectious diseases and autoimmune disorders are one of the biggest challenges for both human and animal health. The prevention and treatment of this kind of diseases is possible at various levels of the pathogenic mechanism underlying this kind of diseases. One approach is to target the ultimate causative agent which means, in case of infectious diseases, the pathogen and in case of autoimmune disease the respective autoreactive antibodies or lymphocytes. Although this is a reasonable and in quite a number of cases successful approach, however, it still has some drawbacks. These drawbacks are, among others, in case of infectious diseases a shortage of means addressing the pathogen, in particular when it comes to viruses, and an increasing number of resistant strains of various bacteria against a number of antibiotics available for the time being, and in case of autoimmune disorder, the need for constant removal or at least neutralization of autoimmune antibodies or autoreactive immune cells with the autoimmune antibodies being the last element of a cascade and thus being rather abundant requiring a therapeutic approach which is also adequate in terms of titres of neutralizing agents needed.

A quite opposite approach for the treatment of this kind of diseases is to modify the immune system such as to treat or even prevent this kind of diseases. The more upstream an immune system modifying agent is active, the broader its potential field of use is. One such element which is a preferred molecule of consideration insofar, is the T cell receptor (TCR) as described in M. M. Davis, J. J. Boniface, Z. Reich, D. Lyons, J. Hampl, B. Arden, and Y. Chien: Ligand recognition by alpha beta T cell receptors *Annu. Rev. Immunol.* 1998. 16: 523-544.

A high level of TCR expression on T lymphocyte surfaces is required in most infections for complete removal of the pathogen. The particular relevance of T cell receptor expression insofar is further illustrated by the fact that it takes ten times more low avidity T cells to control infection than high avidity T cells which is particularly important for the development of vaccines as described by Derby, M., Alexander-Miller, M., Tse, R., and Berzofsky, J: High-avidity CTL exploit two complementary mechanisms to provide better protection against viral infection than low-avidity CTL. *J Immunol* 2001. 166: 1690-1697. The low surface display of antigenic peptides during some virus infection such as, e.g., human immune deficiency virus (HIV) or by hepatitis C virus (HCV) shows that high avidity T cells are needed to protect from infections after vaccination. On the other hand, in autoimmune diseases, obviously, self-antigens are over-recognized by such T cell receptor which, in turn, triggers an over boarding immune response with severe concomitant physiological responses. Insofar, for this kind of disease a blocking of increased surface expression of T cell receptors is highly desirable.

A problem underlying the present invention was thus to provide means for the treatment of immune-related diseases, and more particularly for the treatment and/or prevention of infections and/or autoimmune disorders. In a further aspect, the present invention was to provide means for increasing the T cell receptor expression on T lymphocytes.

BRIEF DESCRIPTION OF THE DRAWINGS

The present invention shall now be further illustrated by reference to the following drawings and examples from which as well as from the sequence listing, further advantages, features and embodiments may be taken.

FIG. 1A shows the result of an analysis of CD3delta RT-PCR samples from T cell cultures raised against cross-reactive peptides 16 and 23 after 4 h stimulation, whereby mRNA from human spleen is used as control;

FIG. 1B shows the result of an analysis of CD3delta RT-PCR samples from freshly isolated PBMCs from healthy donors and from patients with autoimmune diseases, whereby RA means rheumatoid arthritis with lymphocytes having been isolated from knee effusions of three patients; GBS means three patients with Guillian-Barré-Syndrom; CIDP means three patients with chronic inflammatory demyelating polyneuropathy;

FIG. 1C shows the result of a CD3delta RT-PCR of T cell cultures against heteroclitic peptides which were generated with dendritic cells, IL-2, IL-7 and IL-15, whereby the cell cultures have been stimulated for 4 h with the culture peptide or left untreated.

DETAILED DESCRIPTION

Figures 1A, 1B, 1C, 1D:
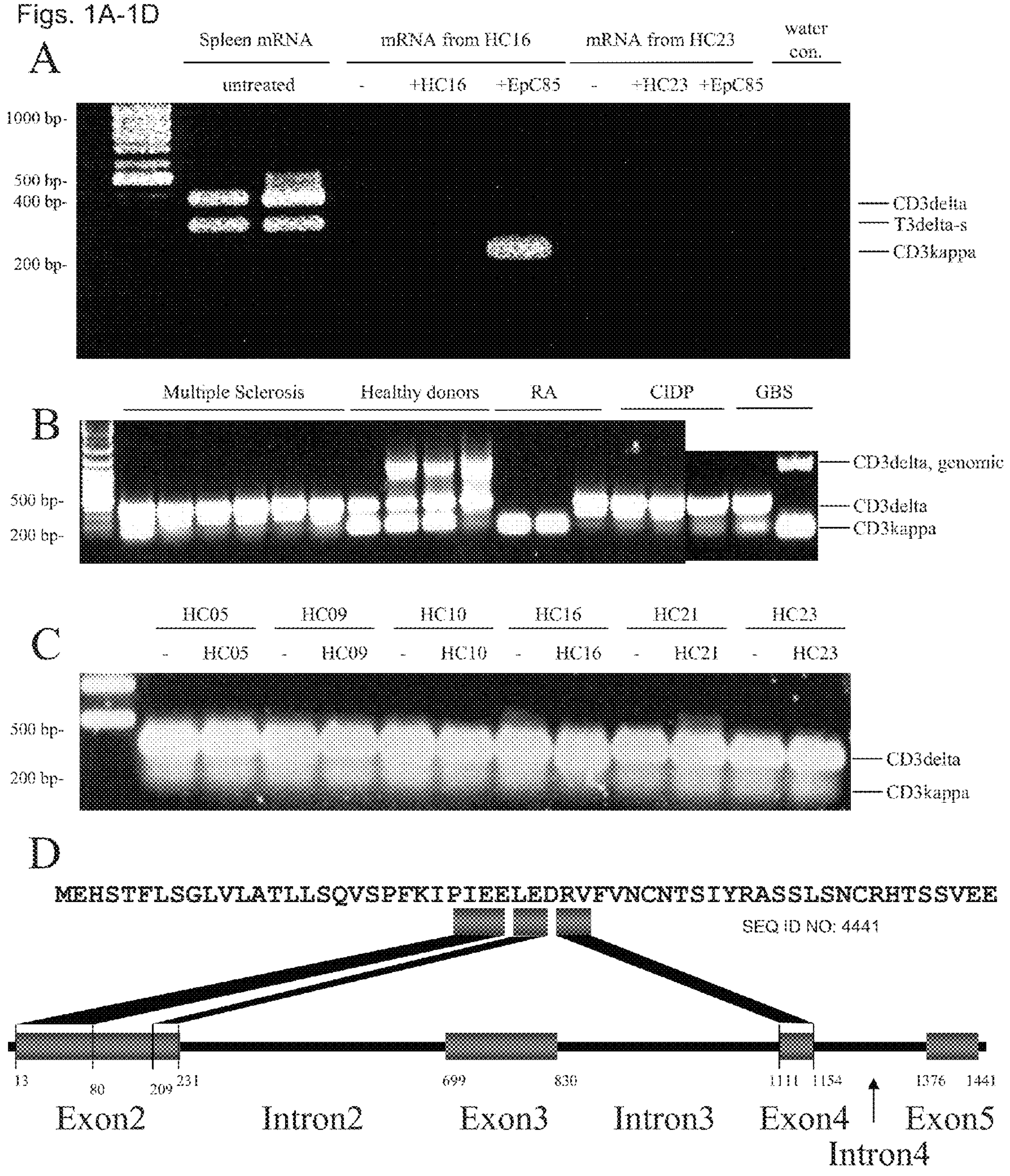
FIGS. 1A to C show a CD3delta RT-PCR visualizing the result of an expression analysis of CD3 delta splice variants, whereby more specifically
FIG. 1D shows the genomic sequence organization of CD3delta and of the derived splice variant CD3 kappa (SEQ. ID. No. 4441), which is a signal peptide linked to SEQ ID NO:4.

In a first aspect the problem underlying the present invention is solved by a peptide comprising an amino acid sequence according to SEQ ID NO:1.

In an embodiment the peptide comprises at least an amino acid sequence encoded by at least one exon of the CD3 gene complex or part thereof.

In a preferred embodiment the amino acid sequence is encoded by exons 2 and 4 of the CD3 gene.

In a second aspect the problem underlying the present invention is solved by a peptide comprising an amino acid sequence according to SEQ ID NO:4.

In an embodiment of the first and the second aspect the peptide increases or prolongs the expression of the T cell receptor.

In a preferred embodiment of the first and the second aspect the expression is the expression of the T cell receptor on the cell surface of T cells, more specifically on the cell surface of T lymphocytes.

In an embodiment of the first and second aspect the peptide blocks or reduces internalization of the T cell receptor.

In an embodiment of the first and second aspect the peptide increases the expression of a compound selected from the group comprising CD4, CD2, CD25, CD116, CD127, CCR5, CCR9, CXCR1, CXCR3, EGF, Eotaxin-2, I-309, IFN-gamma, IL-1 alpha, IL-1 beta, IL-3, IL-6, NAP-2, TGF-beta3, and PARC.

In an embodiment of the first and second aspect the peptide decreases the expression of a compound selected from the group comprising CD58, IL-1ra, IL-8, RANTES, SDF-1, TARC, MCP-4, GRO, soluble IL-6 receptor and soluble TNF-receptor II.

In an embodiment of the first and second aspect the peptide is labelled, preferably by having incorporated a labelled amino acid, whereby more preferably the labelled amino acid is radioactively labelled with tritium, C-14, I-125 or S-35; or whereby the labelled amino acid is labelled with a NMR-active isotope, most preferably with deuterium, C-13 or N-15.

In an embodiment of the first and second aspect the peptide further comprises a moiety which is suitable for detection using a method for detection, whereby such moiety is preferably selected from the group comprising fluorophores, radioactive tracers and haptens, whereby preferably the hapten is biotin.

In a third aspect the problem underlying the present invention is solved by a complex comprising a peptide selected from the group comprising a peptide according to any of claims 1 to 11, and a receptor molecule selected from the group comprising the T-cell receptor, CD4, CD2, CD25, CD127, CCR5, CCR9, CXCR1, CXCR3 and the GM-CSF receptor (CD116).

In a fourth aspect the problem underlying the present invention is solved by a nucleic acid coding for a peptide according to the first and second aspect.

In an embodiment of the fourth aspect the nucleic acid comprises a nucleic acid sequence according to SEQ ID NO:2 or SEQ ID NO:3, or a derivative thereof.

In a preferred embodiment of the fourth aspect the derivative is a nucleic acid (a) which is essentially complementary to the nucleic acid sequence according to SEQ ID NO:2 or to SEQ ID NO:3; or
(b) which hybridises to the nucleic acid sequence according to the nucleic acid sequence according to SEQ ID NO:2 or to SEQ ID NO:3; or
(c) which, but for the degeneracy of the genetic code, would hybridise to the nucleic acid of (a) or (b).

In a more preferred embodiment of the fourth aspect the hybridisation is a hybridisation under stringent conditions In a fifth aspect the problem underlying the present invention is solved by a vector comprising a nucleic acid according to the fourth aspect, whereby the vector is preferably an expression vector.

In an embodiment of the fifth aspect the vector is selected from the group comprising mammalian, microbial, insect and viral vectors.

In a sixth aspect the problem underlying the present invention is solved by a host cell comprising a nucleic acid according to the fourth aspect and/or a vector according to the fifth aspect.

In an embodiment of the sixth aspect, the host cell is an animal cell, preferably a mammalian cell.

In a preferred embodiment of the sixth aspect if the mammalian cell is a human cell, such human cell is an in vitro human cell.

In a seventh aspect the problem underlying the present invention is solved by an organism comprising a host cell according to the sixth aspect, whereby the organism is a non-human animal, preferably a non-human mammal.

In an eighth aspect the problem underlying the present invention is solved by a method for producing a peptide according to the first and second aspect, comprising the following steps:

(a) cultivating a cell according to the sixth aspect in a medium under conditions which allow the production of the peptide; and
(b) harvesting the peptide; and
(c) optionally purifying the peptide.

In a ninth aspect the problem underlying the present invention is solved by the use of a peptide according to the first and second aspect for the manufacture of a medicament.

In a tenth aspect the problem underlying the present invention is solved by the use of a nucleic acid according to the fourth aspect for the manufacture of a medicament.

In an embodiment of the ninth and tenth aspect the medicament is for the treatment and/or prevention of a disease, whereby such disease goes along or is associated with a decreased T cell receptor expression.

In an embodiment of the ninth and tenth aspect the medicament is for the treatment and/or prevention of a disease, whereby such disease goes along or is associated with a decreased expression of a compound selected from the group comprising CD4, CD2, CD25, CD116, CD127, CCR5, CCR9, CXCR1, CXCR3, EGF, Eotaxin-2, I-309, IFN-gamma, IL-1alpha, IL-1 beta, IL-3, IL-6, NAP-2, TGF-beta3, and PARC.

In an embodiment of the ninth and tenth aspect the medicament is for the treatment and/or prevention of a disease, whereby such disease goes along or is associated with an increased expression of a compound selected from the group comprising CD58, IL-1ra, IL-8, RANTES, SDF-1, TARC, MCP-4, GRO, soluble IL-6 receptor and soluble TNF-receptor II.

In a preferred embodiment of the ninth and tenth aspect the disease is selected from the group comprising infectious diseases.

In a more preferred embodiment of the ninth and tenth aspect the disease is selected from the group comprising HIV infection and hepatitis C infection.

In an embodiment of the ninth and tenth aspect the medicament is for the treatment and/or prevention of a disease, whereby such disease is a disease associated with or caused by an increased expression of the T cell receptor, preferably an increased expression of the T cell receptor on the surface of T lymphocytes, and more preferably such disease is selected from the group comprising autoimmune diseases.

In a preferred embodiment of the ninth and tenth aspect the disease is selected from the group comprising rheumatoid arthritis.

In an embodiment of the ninth and tenth aspect the medicament is for immuno-compromised or immuno suppressed patients.

In an embodiment of the ninth and tenth aspect the medicament is for patients suffering from T cell depletion.

In a preferred embodiment of the ninth and tenth aspect the T cell depletion is a drug induced T cell depletion, preferably a T cell depletion induced by a chemotherapeutic agent.

In an embodiment of the ninth and tenth aspect the patients are subject who have or will undergo transplantation.

In an eleventh aspect the problem underlying the present invention is solved by the use of a peptide according to the first and second aspect as and/or for the manufacture of an adjuvant.

In a twelfth aspect the problem underlying the present invention is solved by the use of a nucleic acid according to the fourth aspect as and/or for the manufacture of an adjuvant.

In an embodiment of the eleventh and twelfth aspect the adjuvant is for use in vaccination, preferably in vaccination against poorly immunogenic antigens.

In a thirteenth aspect the problem underlying the present invention is solved by a method for the screening of an agent for the development and/or manufacture of a medicament for the treatment and/or prevention of a disease and/or for the development and/or manufacture of a diagnostic agent for the diagnosis of a disease, whereby the disease is a disease as defined in any of the preceding aspects and any pathological conditions an overexpression or underexpression of the T cell receptor, comprising the steps:

a) providing a candidate compound,
b) providing an expression system for the peptide according to the first and second aspect and/or a system detecting the activity of such peptide;
c) contacting the candidate compound with the expression system for said peptide and/or the system detecting the activity of said peptide;
d) determining if the expression and/or the activity of said peptide is changed under the influence of the candidate compound.

In an embodiment of the thirteenth aspect the candidate compound is contained in a library of compounds.

In an embodiment of the thirteenth aspect the candidate compound is selected from the group of classes of compounds comprising peptides, proteins, antibodies, anticalines, functional nucleic acids, natural compounds and small molecules.

In a preferred embodiment of the thirteenth aspect the functional nucleic acids are selected from the group which comprises aptameres, aptazymes, ribozymes, spiegelmers, antisense oligonucleotides and siRNA.

In a fourteenth aspect the problem underlying the present invention is solved by the use of a peptide according to the first and second aspect or a part or derivative thereof and/or nucleic acid or a part or derivative thereof coding for said peptide or a part or a derivative thereof as target molecule for the development and/or manufacture of a medicament for the treatment and/or prevention of a disease and/or for the development and/or manufacture of a diagnostic agent for the diagnosis of a disease, whereby the disease is a disease as defined in any of the proceeding aspects.

In an embodiment of the fourteenth aspect the medicament and/or the diagnostic agent comprises an agent, which is selected from the group comprising antibodies, peptides, anticalines, small molecules, antisense molecules, aptameres, spiegelmers and RNAi molecules.

In a preferred embodiment of the fourteenth the agent interacts with the peptide according to the first and second aspect.

In an embodiment of the fourteenth the agent interacts with the nucleic acid coding for the peptide according to the first and the second aspect or a part or derivative thereof, in particular with mRNA, genomic nucleic acid or cDNA for said peptide.

In a fifteenth aspect the problem underlying the present invention is solved by the use of a polypeptide which interacts with the peptide according to the first and second aspect or a part or derivative thereof, for the development or manufacture of a medicament for the treatment and/or prevention of a disease and/or for the development and/or manufacture of a diagnostic agent for the diagnosis of a disease, whereby the disease is a disease as defined in any of the preceding aspects.

In an embodiment of the fifteenth aspect the polypeptide is selected from the group, which comprises antibodies against said peptide or a part or derivative thereof and polypeptides binding said peptide or a part or derivative thereof.

In a sixteenth aspect the problem underlying the present invention is solved by the use of a nucleic acid which interacts with a peptide according to the first and second aspect or a part or derivative thereof, for the development or manufacture of a medicament for the treatment and/or prevention of a disease and/or for the development and/or the manufacture of a diagnostic agent for the diagnosis of a disease, whereby the disease is a disease as defined in any of the preceding claims.

In an embodiment of the sixteenth aspect the nucleic acid is selected from the group which comprises aptamers and spiegelmers.

In a seventeenth aspect the problem underlying the present invention is solved by the use of a nucleic acid which interacts with a nucleic acid coding for a peptide according to the first and second aspect or a part or derivative thereof, for the development and/or manufacture of a medicament for the treatment and/or prevention of a disease and/or for the development and/or manufacture of a diagnostic agent for the diagnosis of a disease, whereby the disease is a disease as defined in connection with the first and second aspect.

In an embodiment of the seventeenth aspect the interacting nucleic acid is an antisense oligonucleotide, a ribozyme and/or siRNA.

In an embodiment of the seventeenth aspect the nucleic acid coding for the peptide or a part or derivative thereof is the cDNA, mRNA or hnRNA.

In an embodiment of the fourteenth to seventeenth aspect the disease is a disease associated with or caused by an increased expression of the T cell receptor, preferably an increased expression of the T cell receptor on the surface of T lymphocytes, and more preferably such disease is selected from the group comprising autoimmune diseases.

In an eighteenth aspect the problem underlying the present invention is solved by a pharmaceutical composition comprising at least one agent selected from the group comprising the peptide according to the first and second aspect or a part or derivative thereof, small molecules interacting with the peptide according to the first and second aspect or a part or derivative thereof or with a nucleic acid coding for the peptide according to the first and second aspect or a part or derivative thereof, antibodies specific for the peptide according to the first and second aspect or a part or derivative thereof, polypeptides interacting with the peptide according to the first and second aspect or a part or derivative thereof, a nucleic acid coding for the peptide according to the first and second aspect or a part or derivative thereof, nucleic acids interacting with the peptide according to the first and second aspect or a part or derivative thereof or nucleic acids interacting with a nucleic acid coding for the peptide according to the first and second aspect or a part or derivative thereof, and at least one pharmaceutically acceptable carrier, preferably for the prevention and/or the treatment of a disease whereby the disease is a disease as defined in any of the preceding claims.

In a nineteenth aspect the problem underlying the present invention is solved by a kit for the characterisation of a disease or a condition as defined in any of the preceding claims, comprising at least one agent which is selected from the group comprising the peptide according to the first and second aspect or a part or derivative thereof, antibodies specific for the peptide according to the first and second aspect or a part or derivative thereof, polypeptides interacting with the peptide according to the first and second aspect or a part or derivative thereof, polypeptides interacting with a nucleic acid coding for the peptide according to the first and second aspect or a part or derivative thereof, nucleic acids interacting with the peptide according to the first and second aspect or a part or derivative thereof, nucleic acids interacting with a nucleic acid coding for the peptide according to the first and second aspect or a part or derivative thereof, and optionally at least one other compound.

The present inventors have surprisingly found that the sensitivity and function of T lymphocytes to antigenic stimulation can be increased by a peptide which is referred to herein as CD3 kappa and its derivatives. Also, the present inventors have surprisingly found that CD3 kappa is suitable to improve the surface expression of the T cell receptor on the surface of cells. Finally the present inventor has found that CD3 kappa has a direct or indirect impact on the expression of distinct Cytokines and/or Chemokines, and on the expression of some Chemokine and/or Cytokine-Receptors.

More particularly, the present inventors have found a new splice variant of CD3 providing a new open reading frame comprising the amino acid sequence according to SEQ ID NO. 1. This open reading frame encodes a peptide which is responsible for changing the characteristics and biological behaviour of the splice variant of CD3 disclosed herein. This peptide has the amino acid sequence according to SEQ ID NO:4 and is referred to as CD3 kappa or CD3 kappa peptide. Without wishing to be bound by any theory, the peptide encoded by this new open reading frame and the CD3 kappa peptide, respectively, seems to avoid the internalization of the T cell receptor thus being, either directly or indirectly, involved in the improved, this is to say increased and/or prolonged surface expression of the T cell receptor. The peptide which is encoded by said new open reading frame is also referred to herein as CD3 kappa-ORF. Said CD3 kappa-ORF forms the C terminal part of CD3 kappa peptide having the amino acid sequence according to SEQ ID NO. 4. CD3 kappa is another splice variant of CD3 delta. Compared to CD3 delta, however, CD3 kappa is lacking exon 3 and a part of exon 2 but contains the entire exons 1, 4 and 5. CD3 kappa is in particular expressed by peripheral blood leukocytes, optionally along with other CD3 delta isoforms. CD3 kappa is, again without wishing to be bound by any theory, suitable to increase the sensitivity of T lymphocytes to antigenic stimulation, whereby such increased sensitivity seems to be based on an improved expression and/or surface display of the TCR on T lymphocytes. Also, CD3 kappa is, without wishing to be bound by any theory, suitable to provide for an improved expression of the TCR on T lymphocytes, more specifically on the surface of T-lymphocytes.

CD3 kappa also, moreover without wishing to be bound by any theory, has a direct or indirect effect on the expression of distinct Cytokines and/or Chemokines, and on the expression of some Chemokine and/or Cytokine-Receptors. More specifically CD3 kappa leads to an increased release of proinflammatory cytokines and chemokines, most specifically of EGF, Eotaxin-2, I-309, IFN$\gamma$, IL-1$\alpha$, IL-1$\beta$, IL-3, IL-6, NAP-2, TGF$\beta$3 and PARC; while CD3 kappa induces a decreased release of IL-1ra, IL-8, RANTES, SDF-1, TARC, MCP-4, GRO, soluble IL-6 Receptor and soluble TNF-Receptor II by peripheral blood mononuclear cells. The described changes in secretion occur more specifically after about 24 h upon addition of CD3 kappa and last for up to eight days in vitro. CD3 kappa leads to an up-regulation of CD4 and CD2, and of some Chemokine and Cytokine-Receptors, more specifically of Cytokine/Chemokine-Receptors which lead to anti-apoptotic and/or proliferation inducing effects. Most specifically CD3 kappa leads to an up-regulation of CD25, CD116, CD127, CCR3, CCR9 and CXCR1. CD3 kappa also leads to a slight upregulation of CXCR3 and CXCR4.

As preferably used herein, the term “improved expression” or “upregulation” shall, in a preferred embodiment, mean that the expression of the TCR and of the Cytokine/Chemokine-receptors is increased, whereby such increase in expression can be, alternatively or additionally, a prolonged expression of the individual receptor or an increase of the number of individual receptors preferably by increased translation and/or transcription. More preferably, the lifetime of the expression of the individual receptor is increased.

In a preferred embodiment the term “surface expression” or “up-regulation” shall be the presence of the TCR and of the Cytokine/Chemokine-receptors on a surface of a cell. Preferably, the cell is a mammalian cell and more preferably the cell is an immune and/or hematopoetic cell, e.g., a T lymphocyte and most preferably the cell is a CD4+ T lymphocyte.

In a preferred embodiment, the T cell receptor is the human T cell receptor and is, for example, described in M. M. Davis, J. J. Boniface, Z. Reich, D. Lyons, J. Hampl, B. Arden, and Y. Chien: Ligand recognition by alpha beta T cell receptors *Annu. Rev. Immunol.* 1998. 16: 523-544.

The term “surface” as preferably used herein refers to a surface present either on the outside of the cell or on the boundary of a cell which is preferably formed by a cytoplasm membrane separating the cytoplasm of a cell from the environment around a cell, or to rapidly exchanged or exchanging membrane compartments which are preserved in intracellular compartments e.g. endosomes or lysosomes, in which parts of the cytoplasm membrane is recycled or recycling. Most preferably the term "surface" refers to lipid rafts in the cytoplasm membrane.

The T cell receptor is an alpha:beta-heterodimer consisting of one T cell receptor-alpha chain and one T cell receptor-beta (TCR beta) chain. About 30,000 molecules of this kind of T cell receptors are present on a normal human T cell. Apart from the alpha:beta T cell receptor, there is also a subpopulation of T cells with a T cell receptor which is different from the alpha:beta T cell receptor and consists of a heterodimer of gamma- and delta chains. In connection with the present invention, these gamma:delta-T cell receptors or other theoretically possible heterodimeric receptors consisting of two of these four chains are comprised by the term alpha:beta-T cell receptors which is, in turn, generally referred to as T cell receptor or TCR.

Also, the term T cell receptor shall comprise the T cell receptor complex, if not explicitly stated to the contrary. Such T cell receptor complex comprises apart from the T cell receptor in the narrower sense, i.e., consisting of the alpha: beta-heterodimer, also in general four CD3 molecules or functional homologous molecules, namely gamma, delta, epsilon, eta and also zeta, whereby CD3 epsilon forms a complex with either the CD3 delta or the CD3 gamma chain. CD3 zeta can be a homodimer or a Heterodimer with CD3 eta or other molecules. However the lack of one or more CD3 chains is possible, including any variations as found by different splicing. It will be acknowledged that other factors may be comprised by the T cell receptor complex and thus by the T cell receptor as used herein.

In a preferred embodiment the term that "the expression of the T cell receptor is increased", refers to the result of a comparison made between the T cell receptor in a patient with CD3 kappa and a healthy subject without CD3 kappa. A patient is preferably a diseased subject or a subject suspected of suffering from a disease or a subject being prone to such disease. A healthy subject preferably is either the same or a different subject not being diseased or not being prone to be diseased or a group of persons not diseased or not being prone to be diseased. The comparison is made between a patient and a healthy subject, whereby the measures needed insofar are preferably commonly known to the ones skilled in the art. Preferably such measures comprise obtaining a sample from the patient and healthy subject, respectively. Preferably such sample is a blood sample or effusions from inflamed tissues such as, e.g., the knee. In case of healthy subjects such samples may be taken at any time. In case of patients such samples are preferably taken prior, during and after the treatment. Such frequent sampling also allows for a staging of the disease as well as a monitoring and deciding whether the therapy used is actually effective. In case of patients who received high doses of myelotoxic chemotherapy or who undergo therapy with biologicals are most preferably taken when these patients are reconstituted in blood formation with leukocyte values around or above 1/nl. The isolated mononuclear cells are incubated with CD3 kappa for 1 to 6 days and tested for the ability of CD3 kappa to improve the function of leukocytes as described below. This diagnostic approach shows whether an immune defect is actually present which is treatable with CD3 kappa. In a further step, the comparison comprises the determination of the expression of the TCR. The expression of the TCR can be determined by various means, preferably on T-lymphocytes of the patient and healthy subject, respectively, and more particularly on the samples obtained there from. Among others, and not limited thereto, the expression can be determined by using compounds specifically interacting with the TCR. Such specifically interacting compounds are preferably selected from the group comprising antibodies, high affinity binding peptides, anticalines, aptamers and spiegelmers. For purpose the expression of the cytokines and chemokines, respectively, and the cytokine/chemokine receptors described herein as being related to or associated with the TCR expression, are analysed as well. This will show an improvement of function of leukocytes in general by bystander effects e.g. by secretion of factors or more specially of the herein described cytokines by the CD3 kappa modulated mononuclear cells. The expression of Cytokine/Chemokine-receptors and the expression of distinct Cytokines and/or Chemokines can be assessed on mononuclear cells. This expression analysis is preferably done by flow-cytometric analysis and leads to Mean-Fluorescence indices (MFI), which are direct proportional to the TCR or the Cytokine/Chemokine-receptor expression strength. The release of Cytokines and/or Chemokines can be determined by the use of specific antibodies which are labelled or which lead to the enzymatic generation of measurable products. Alternatively, the expression of the TCR, of the said other receptors or of the said cytokines can be determined by functional assays, whereby such functional assays preferably comprise the following steps: Cell culture of lymphocytes followed by peptide stimulation and analysis of cytokine expression with cytokine specific antibodies. Preferably, the expression between a patient and a healthy person is increased by a value of at least 10%, 20%, 50%, 100% or more. This increase depends on the basal TCR expression in the patient and might range from 20% in healthy individuals to 2500% in patients with severe compromised immune function after high doses of chemotherapy and therapy with biologicals. This percentage may refer as a measure to the number of T cell receptors present on a surface or the time an individual T cell receptor is available on such surface, whereby it is to be acknowledged that the time may be the average time of a group of T cell receptors or the average time of the T cell receptor on a group of lymphocytes, preferably the lymphocytes contained in the sample or a fraction thereof. More specifically, the incubation time is at least 4 hours to enable recycling of TCRs from various cellular compartments. The increase in the expression of the above named Cytokine/Chemokine-receptors and the said cytokines is analyzed in the same way. It will be understood by the ones skilled in the art that the samples are standardized in a preferred embodiment.

In a preferred embodiment, the difference in TCR expression between a patient population with MFIs below 22 and healthy subjects with a MFI around 115 is by a factor of 6, whereby such difference is preferably observed within 24 hours after in vitro culture and preferably lasts for at least two days, preferably at least four days and more preferably at least six days. The difference in the patients and the healthy subjects corresponds to the mean value of TCR expression of the healthy subjects plus five times the standard deviation, making the difference statistically highly significant. In a similar way, the CD4-receptor expression is different between a patient population and healthy subjects. However in the case of CD4, the difference is visible preferably after six days after in vitro culture.

Most patients with higher TCR expression as the patients described above show a MFI around 45 which correspond to a difference to the mean value of TCR expression of the healthy subjects plus three times the standard deviation and is still a statistically significant reduced TCR expression as compared to the healthy subjects. In a similar way as particularly described in the previous paragraph, the difference of TCR- and/or CD4-receptor expression is visible after in vitro culture as described this paragraph.

The present inventors have found that in the described patient populations the expression of the TCR in the T lymphocytes can be increased in a statistically significant manner by CD3 kappa and its derivatives to normal values as defined by healthy individuals. As will be outlined in more detail herein, such increase can be used for or is the basis of any treatment and/or prevention of diseases which are characterized by or associated with a decreased TCR level, preferably TCR level on the T lymphocytes. However also the expression of the said cytokines, more preferably of Th1-cytokines and most preferably of IFNγ can be increased in a statistically significant manner by CD3 kappa and its derivatives to normal values as defined by healthy individuals.

Preferably, the increase in TCR, CD4- and/or CD2-expression after CD3k CD3 kappa peptide treatment can be detected in an in vitro culture at peptide concentrations higher than 1-10 μg/ml, more preferably at concentrations of 10-100 μg/ml, even more preferably at concentrations of 100-500 μg/ml and most preferably at concentrations of 500-2000 μg/ml or even higher concentrations. The upregulation can be detected within 48 hours and is by at least a factor of 50%, more preferably at least 100% and even more preferably at least 200% as compared to the respective negative control. This expression analysis is preferably done by flow-cytometric analysis as described above. Alternatively, the expression of the TCR can be determined by functional assays, whereby such functional assays preferably comprise the following steps: Cell culture of lymphocytes followed by peptide stimulation and analysis of cytokine expression with cytokine specific antibodies. The expression of Cytokine/Chemokine-receptors and the expression of distinct Cytokines and/or Chemokines can be assessed on mononuclear cells in the same way. In another embodiment, the increase in TCR, CD4- and/or CD2-expression is by a factor of at least 2, preferably at least 4 and more preferably at least 6 fold, preferably each within 48 hours, whereby the respective lymphocytes used for the assessment from patients recovering from treatment with T-cell toxic chemotherapeutic agent, whereby preferably the agent is fludarabine and/or alemtuzumab. The increase in TCR, CD4- and/or CD2-expression described should preferably be shown at a concentration of 5-1000 μg/ml peptide versus no peptide or versus a control peptide with random sequence. Most preferably the increase in TCR, CD4- and/or CD2-expression described should be shown at a concentration of 0.5-1 mg/ml CD3kappa peptide versus no peptide or versus a control peptide with random sequence.

The term CD3 kappa or CD3 kappa peptide as used herein also comprises derivatives of the peptide having SEQ ID NO. 4, as obvious for the one skilled in the art. Insofar the term CD3 kappa peptide or CD 3 kappa peptides comprise, in a preferred embodiment of the present invention CD3 kappa having the amino acid according to SEQ ID NO:4 and any derivative thereof, preferably any derivative as defined and/or disclosed herein. A derivative of CD3 kappa as preferably used herein is any peptide preferably having at least one of the characteristics of CD3 kappa having the amino acid sequence according to SEQ ID NO. 4. More specifically, such characteristic is any of the characteristics described herein for CD3 kappa and more preferably described for CD3 kappa having an amino acid sequence according to SEQ ID NO:4. More preferably, such characteristic is the capability to increase the TCR, CD4- and/or CD2-expression within 24 hours by a factor of at least 25%, more preferably at least 50%, even more preferably at least 100% and most preferably 200%. Preferably, such increase in the TCR, CD4- and/or CD2-expression within 24 hours should be observable at peptide concentrations higher than 1-10 μg/ml, more preferably at concentrations of 10-100 μg/ml, even more preferably at concentrations of 100-500 μg/ml and most preferably at concentrations of 500-2000 μg/ml or even higher concentrations. One of the assays in principle useful to determine this or similar characteristics of CD3 kappa in general and the derivatives of CD3 kappa having the amino acid sequence according to SEQ ID NO. 4 in particular, is described in the attached examples, whereby other or different assays are either known to the one skilled in the art or will be obvious for the one skilled in the art in the light of the present disclosure.

In principle, the derivatives of CD3 kappa and in particular of CD3 kappa having the amino acid sequence according to SEQ ID NO:4 can be divided into the following groups: full-length derivatives, truncated derivatives and modified derivatives.

Full-length derivatives have the same length as the CD3 kappa peptide according to SEQ ID NO:4 or comprise the complete amino acid sequence of CD3 kappa having the amino acid sequence according to SEQ ID NO:4. Full-length derivatives are characterized by one or several changes made to at least one or several amino acids forming the peptide. Such changes are preferably related to the side-chain of the amino acid. However, it is also within the present invention that a full-length derivative has the same sequence of side-chains but the backbone forming entities such as amino acids or derivatives thereof is changed, i.e. different from the peptide backbone obtained or observed when two or more amino acids are covalently linked to each other through a peptide bond whereby this kind of compound belongs to the group called peptidomimetics, which are formed e.g. through exchange of the amide-peptide-binding by urea resembling so called 'ureidopeptides' as shown by Barth B S, Myers A C and Lipton M A.: Exploring the stereochemical requirements for protease inhibition by ureidopeptides. *J Pept Res.* 2005 March; 65(3):352-4; or through exchange of the amide-peptide-binding by thioamide-linkage yielding Endothiopeptides as shown by Yao S, Zutshi R and Chmielewski J.: Endothiopeptide inhibitors of HIV-1 protease. *Bioorg Med Chem. Lett.* 1998 Mar. 17; 8(6):699-704. Such non-peptide backbone can be present in the derivative either only for one building block or for several of the building blocks forming the derivative or, by reference to the CD3 kappa peptide having the amino acid sequence according to SEQ ID NO:4, for one or several of the amino acids, including the complete backbone thereof. This kind of modification is preferably used to reduce enzyme degradation in vivo or improve peptide binding which has been shown e.g. by Abdel-Rahman H M, Kimura T, Hidaka K, Kiso A, Nezami A, Freire E, Hayashi Y, Kiso Y.: Design of inhibitors against HIV, HTLV-I, and *Plasmodium falciparum* aspartic proteases. *Biol. Chem.* 2004 November; 385(11):1035-9.

The term full-length derivative also comprises derivatives which contain the full-length amino acid sequence of the CD3 kappa peptide according to SEQ ID NO:4 and one or several further or additional amino acids, whereby such further amino acids are additionally or alternatively attached to the N-terminus or to the C-terminus. Furthermore, each of the further amino acid(s) can be attached to any of the side-chain of the amino acids and building blocks, respectively, forming the derivative of the CD3 kappa peptide according to SEQ ID NO:4. It is also within the present invention that this kind of full-length derivatives comprises at one or several amino acid positions, relative to the amino acid sequence according to SEQ ID NO:4, one or several amino acids or further building blocks incorporated into the amino acid sequence, more specifically, the backbone of the respective amino acid sequence, whereby the backbone is preferably a peptide backbone. Also, the full-length derivative is in an embodiment a modified derivative, preferably a modified derivative as defined herein. It is also within the present invention that the embodiments described in the present section are embodiments of the derivatives described in the preceding section.

The full-length derivatives of the CD3 kappa peptide comprising changes in the amino acid sequence relative to the sequence of CD3 kappa having the amino acid sequence according to SEQ ID NO:4 at one or several positions, preferably without that such derivative lacks one of the characteristics of a CD3 kappa peptide as defined herein, are preferably characterized in that an amino acid of a distinct category is replaced by another amino acid of the same category. Such categories are preferably neutral amino acids, aliphatic amino acids, cationic amino acids, anionic amino acids, thiol-containing amino acids, aromatic amino acids and heterocyclic amino acids. As peptides may be obtained by protocols of organic synthesis, amino acid replacements are not limited to those of proteinogenic amino acids. Any building block including, but not limited to, non-proteinogenic amino acids, beta-amino acids, D-amino acids and L-amino acids or completely synthetic amino acids or amino acid like compounds like the transition state mimetic allophenylnorstatine that may be incorporated by suitable chemical procedures, may be included in the peptide.

To the extent the full-length derivatives of the CD3 kappa are generated by the exchange of one or several of the amino acids of the CD3 kappa peptide having the amino acid sequence according to SEQ ID NO:4, the peptides having SEQ ID NO. 5-4417 are disclosed herein as exemplary full-length derivatives of the CD3 kappa peptide.

Truncated derivatives of the CD3 kappa peptide are peptides comprising a part of the amino acid sequence of the CD3 kappa peptide and its derivatives, in particular the full-length derivatives. In an embodiment the truncated derivative exhibit the changes described above for the full-length derivatives, whereby the overall length of the truncated derivative is shorter, at least by one amino acid or a building block compared to the CD3 kappa according to SEQ ID NO:4 and the full-length derivatives, preferably the full-length derivatives described herein. In a further embodiment these truncated derivatives preferably comprise a core sequence of as little as 12 amino acids, preferably 18 amino acids and more preferably 25 amino acids. The sequence of this kind of truncated derivatives may start, in terms of N-terminal end, at the N-terminus or any other position relative to the full length sequence of CD3 kappa having the amino acid sequence according to SEQ ID NO:4 or any of the full-length derivatives described herein.

To the extent the derivatives of the CD3 kappa are generated by truncating the amino acid sequence of CD3 kappa having the amino acid sequence according to SEQ ID NO:4 and of the full length derivatives thereof, preferably as disclosed herein, the peptides having SEQ ID NO. 4418-4437 are disclosed herein as exemplary truncated derivatives thereof.

A modified derivative is any derivative of the CD3 kappa peptide having the amino acid sequence according to SEQ ID NO:4, of any full-length derivative or of any truncated derivative exhibiting at least one further modifying group. Such modifying group can be present at or attached to the N-terminus, the C-terminus or any of the amino acids or building blocks, including any side chain thereof, forming the CD3 kappa peptide having the amino acid sequence according to SEQ ID NO:4, any full-length derivative thereof or any truncated derivative thereof. In a preferred embodiment, the modifying group is different from an amino acid or any of the building blocks forming the CD3 kappa peptide having the amino acid sequence according to SEQ ID NO:4, any full-length derivative thereof or any truncated derivative thereof. More preferably, the modifying group is selected from the group comprising acetate group, phosphor group and sugar group, more preferably glucose group. Most preferably the modifying sugar groups as N-acetyl-D-glucosamine or N-acetyl-D-galactosamine are attached to one or more serine residues at positions 1, 4 24, 29, 30, 32 38 and/or 39, and/or to the threonine residue at position 23, and/or to one or more asparagine residues at positions 20, 22 and/or 33. The modifying sugar groups include oligo- and polyglycans.

It is to be acknowledged by the one skilled in the art that in a preferred embodiment additionally or alternatively a peptide having homology of at least 80%, 85%, 90%, 95%, 96%, 97%, 98% or 99% compared to either the CD3 kappa peptide according to SEQ ID NO:4, any full-length derivative thereof or any truncated derivative thereof shall be regarded as a derivative of CD3 kappa, preferably under the proviso that the derivative and/or the peptide to which is referred for the purpose of comparison, still exhibits at least one of the characteristics of the CD3 kappa peptide according to SEQ ID NO:4.

In a preferred embodiment the CD3 kappa peptide further comprises a moiety which is suitable for detection. More specifically, such moiety allows for the detection of the peptide and/or any receptor interacting therewith. The moiety may be any group suitable for such purpose. Respective moieties are known to the one skilled in the art and comprise, however, are not limited to, fluorophors such as for example carboxyfluorescein or biotin. Preferably, the detection is caused by means of fluorescence. Alternatively, the detection may also occur by means of radioactivity, e.g. after incorporation of tritium, C-14, I-125 or S-35 by protocols known to the one skilled in the art. Detection may occur at the level of an individual cell, a tissue, an organ or an animal. Preferably the animal is a mammal and more preferably selected from the group comprising dog, cat, sheep, goat, rat, mouse, cow, horse and a human being. Detection may occur in vitro, in situ, in vivo, and/or ex vivo.

CD3 kappa peptide also comprises a moiety which is suitable for detection and/or determination of the molecular structure and/or of biochemical properties. Labelling might be done by incorporation of NMR-active isotopes, most preferably deuterium, C-13 or N-15.

In a further aspect, the present invention is related to a nucleic acid coding for the CD3 kappa peptide, i.e. the CD3 kappa peptide having the amino acid sequence according to SEQ. ID:No. 4, any full-length derivative, any truncated derivative and any modified derivative also referred to herein in their entity as the CD3 kappa peptide or CD3 kappa peptides.

It will be acknowledged by the one skilled in the art that due to the genetic code, it is possible to perceive a nucleic acid sequence coding for the CD3 kappa peptides as disclosed herein. It is obvious that due to the degeneracy of the genetic code, different nucleic acid sequences coding for the same peptide are possible insofar. The preferred nucleic acid sequence for the new open reading frame is the one according to SEQ ID NO:2 and the preferred nucleic acid coding for CD3 kappa having the amino acid sequence according to SEQ ID NO:4, is the nucleic acid sequence according to SEQ ID NO:3.

A further factor which can have an impact on the particular nucleic acid sequence and its design is based on the specific codon usage of the host organism which is used for the expression of the respective nucleic acid sequence. This is also known to the one skilled in the art and can be used for the design of a particular nucleic acid sequence coding for the CD3 kappa peptides as disclosed herein.

The nucleic acids according to the present invention also comprise sequences which are at least partially complementary to such nucleic acid sequences. Preferably, the nucleic acids are homologous to such nucleic acid sequence, whereby the homology is preferably at least 80%, 85%, 90%, 95%, 96%, 97%, 98% or 99%, respectively.

Also, the nucleic acid sequences according to the present invention comprise those which hybridize to any of the nucleic acid sequences disclosed herein. Preferably, the hybridization occurs under conditions of high stringency as, for example, described in Southern, E. M. (1975) J. Mol. Biol. 98, 503-517.

Also, the nucleic acid sequences according to the present invention comprise those which, but for the degeneracy of the genetic code, would hybridize to any of the afore-defined nucleic acid sequences. Preferably the hybridization conditions are conditions of high stringency as, for example a hybridization solution consisting of 1.5×SSPE (0.27 M NaCl, 15 mM sodium.

phosphate (pH 7.7), 1.5 mM EDTA), 0.5% (w/v) non-fat powdered milk; 14), and 1% (w/v) SDS with hybridization carried out at 68° C. for up to 20 h, as described in Khandjian, E. W. (1987) Biotechnology 5, 165-167 or Reed, K. C. and Mann, D. A. (1985) Nucl. Acids Res. 13, 7207-7221.

The nucleic acids according to the present invention such as specifically those disclosed herein may be present in an isolated form, as RNA, as DNA or as hybrids thereof. Preferably, the nucleic acid sequences according to the present invention are contained in a vector. Such a vector is preferably a plasmid vector or a viral vector, however, not limited thereto. A vector as preferably used herein is a nucleic acid sequence which is suitable to express a nucleic acid cloned into it. Preferably such vector comprises a sequence which allows the vector to preferably stably replicate in a host organism and to express the nucleic acid sequence encoded by said vector. Preferably the expression is controlled by a promoter and optionally other expression-regulating factors and sequences, respectively. Vectors are most preferably expression vectors which are known to the one skilled in the art. Depending on the host organism where such vector shall be used and expressed, respectively, the vector can be a mammalian vector, an insect vector, a microbial vector and a viral vector, respectively. This includes also transfection with RNA e.g. of dendritic cells as described in Gilboa E, Vieweg J. Cancer immunotherapy with mRNA-transfected dendritic cells. Immunol Rev. 2004 June; 199:251-63.

Examples of a possible mammalian vector include pCMV4 as described by Andersson, S., Davis, D. L., Dahlback, H., Jornvall, H., Russell, D. W.: Cloning, structure, and expression of the mitochondrial cytochrome P-450 sterol 26-hydroxylase, a bile acid biosynthetic enzyme. J Biol Chem. 1989 May 15; 264(14):8222-9 or an insect vector like a baculovirus which can be either used to transfect insect cell for recombinant protein production or used to transfer genetic material into mammalian cells, as described in Hu Y C. Baculovirus as a highly efficient expression vector in insect and mammalian cells. Acta Pharmacol Sin. 2005 April; 26(4): 405-16 or in Tani H, Limn C K, Yap C C, Onishi M, Nozaki M, Nishimune Y, Okahashi N, Kitagawa Y, Watanabe R, Mochizuki R, Moriishi K, Matsuura Y. In vitro and in vivo gene delivery by recombinant baculoviruses. J Virol. 2003 September; 77(18):9799-808.

Examples of possible microbial vectors are pUC18, pUC19, pBluescript or pBR322 as described in Sambrook, J., Fritsch, E. F., and Maniatis, T. (1989). Molecular Cloning: A Laboratory Manual, Second Edition (Plainview, N.Y.: Cold Spring Harbor Laboratory Press) or in Ausubel, F. M., Brent, R., Kingston, R. E., Moore, D. D., Seidman, J. G., Smith, J. A., and Struhl, K. (1994). Current Protocols in Molecular Biology (New York: Greene Publishing Associates and Wiley-Interscience).

Preferred viral vectors are retroviral vectors like pLN, pLXSN, pLNCX, pLNSX, pLNL6, pLXSHD, pLHDCX or pLXSH as described in Coffin, J. M. & Varmus, H. E., Eds. (1996) Retroviruses (Cold Spring Harbor Laboratory Press, NY), adenoviral vectors like pAdTrack-CMV, pAdTrack or pShuttle-CMV as described in He T C, Zhou S, da Costa L T, Yu J, Kinzler K W, Vogelstein B. A simplified system for generating recombinant adenoviruses. Proc Natl Acad Sci USA. 1998 Mar. 3; 95(5):2509-14 or adeno-associated virus vectors for gene transfer into mammalian cells as described in Zolotukhin S. Production of recombinant adeno-associated virus vectors. Hum Gene Ther. 2005 May; 16(5):551-7.

In a further aspect, the present invention is related to a host cell comprising either a nucleic acid according to the present invention or a vector according to the present invention. Preferably, the host cell is an animal cell and more preferably a mammalian cell. However, the host cell may also be a microbial cell, both a prokaryotic cell and a eukaryotic cell such as a yeast cell or an insect cell.

In case the cell is a mammalian cell and more particularly a human cell, such cell is preferably an isolated human cell. Most preferably the cell is a cell of hematopoetic origin.

It will be appreciated by the one skilled in the art that once such a nucleic acid, vector and host cell, respectively, in accordance with the present invention, is available, the respective peptide can be synthesised using an expression system. Preferably a respective host cell is cultivated in a medium under conditions which allow the production of the peptide encoded by the nucleic acid sequence which is preferably exogenously introduced into said cell. Subsequently, the peptide is harvested, whereby such harvest can be from the culture supernatant or from the cellular cytoplasm upon disrupting the host cell.

Any such vectors, host cells and other elements described herein are as such known to the one skilled in the art and are, for example, described in Sambrook, J., Fritsch, E. F., and Maniatis, T. (1989). Molecular Cloning: A Laboratory Manual, Second Edition (Plainview, N.Y.: Cold Spring Harbor Laboratory Press) or in Ausubel, F. M., Brent, R., Kingston, R. E., Moore, D. D., Seidman, J. G., Smith, J. A., and Struhl, K. (1994). Current Protocols in Molecular Biology (New York: Greene Publishing Associates and Wiley-Interscience) which is incorporated herein by reference.

As disclosed herein, the CD3 kappa peptides improve the surface expression of the T cell receptor, of CD4, CD2, and of some Chemokine and Cytokine-Receptors, more specifically of Cytokine/Chemokine-Receptors which lead to antiapoptotic and/or proliferation inducing effects and have thus an effect which is supportive to the TCR related effects described herein. Most specifically CD3 kappa leads to an up-regulation of CD25, CD116, CD127, CCR3, CCR9 and CXCR1. CD3 kappa also leads to a slight up-regulation of CXCR3 and CXCR4. Based thereon, in principle, any disease involving the T cell receptor and accordingly any disease involving reduced T cell function and/or reduced survival of T-lymphocytes can be treated or prevented by influencing, either directly or indirectly, the CD3 kappa peptide mediated improved surface expression of TCR and of the antiapoptotic and/or proliferation inducing receptors specified herein. Therefore, the diseases for the prevention and/or treatment of which the CD3 kappa peptides and the nucleic acids coding therefor as well as any other of the CD3 kappa peptide related compounds which are described and disclosed herein, can be specifically used are immune-related diseases. Immune-related diseases as preferably used herein are diseases which are characterized by the TCR, the anti-apoptotic and/or proliferation inducing receptors specified herein, and/or the cytokines specified herein which are involved in the pathogenetic mechanism, whereby such pathogenetic mechanism allows that by modifying the surface expression of the T cell receptor to prevent, ameliorate, relieve or cure such disease, either directly or indirectly via the other receptors and cytokines, respectively, specified herein.

To the extent that a disease is characterized by an, in the broader sense, insufficient T cell receptor expression, the CD3 kappa peptides and the nucleic acid coding therefor, can be used for the treatment and prevention, respectively, of such disease. As preferably used herein, the term insufficient T cell receptor expression refers to a level of expression which gives rise to, is linked to or is associated with a pathological condition which is the respective disease, a pre-stage thereof or which increases the susceptibility of a subject for such disease. More specifically, the diseases for the treatment and prevention of which CD3 kappa peptides and the nucleic acids coding therefor, can preferably be used are HIV/Aids, immune defect after treatment with chemotherapy, such as, treatment with a nucleoside-analogue like fludarabine, cytarabine, gemcitabine; an alkylating agent like cyclophosphomide, melphalan, BCNU; an antibody like Alemtuzumab; an anthracycline like doxorubicin, daunorubicin or idarubicine; or radiation; enhancement of the function of ex vivo or in vitro generated T cells for, e.g. adoptive T cell therapy; common variable immunodeficiency, severe combined immunodeficiencies, treatment of cancer, augmentation of cellular immunity and treatment of infections. Most specifically, patients with a lower TCR expression are defined by a difference to the mean value of TCR expression of the healthy subjects plus three times the standard deviation which is statistically significant reduced TCR expression.

Additionally, the diseases may be autoimmune disorders which can be treated via stimulation of regulatory T cells, whereby the autoimmune diseases are particularly those disclosed herein, more specifically those disclosed which can be treated and prevented, respectively, by using the CD3 kappa peptide related compounds. Without wishing to be bound by any theory such kind of diseases can be treated and/or prevented by reducing the effect of the CD3 kappa peptide the abundant titre of which is characteristic for this kind of diseases.

In principle, the treatment and/or prevention of each and any infection is an infectious disease caused or associated with one or several of the viruses and organisms, respectively, recited in table 1. Most preferably CD3 kappa peptides are used as adjuvants for vaccines for the treatment and/or prevention of such diseases or for the treatment and/or prevention of chronic and/or probably lethal forms of such diseases.

TABLE 1

Infectious diseases which can be treated in accordance with the present invention

| | | | | | |
|---|---|---|---|---|---|
| 1. | Human immundefiency virus | - | H10N4 subtype | - | H12N8 subtype |
| | 1-Infection | - | H10N5 subtype | - | H13N2 subtype |
| 2. | Human immundefiency virus | - | H10N7 subtype | - | H13N3 subtype |
| | 2-Infection | - | H10N8 subtype | - | H13N6 subtype |
| 3. | Human immundefiency virus | - | H10N9 subtype | - | H13N7 subtype |
| | 3-Infection | - | H11N1 subtype | - | H14N5 subtype |
| 4. | Human T-cell lymphotropic | - | H11N13 subtype | - | H14N6 subtype |
| | virus | - | H11N2 subtype | - | H15N8 subtype |
| 5. | Hepatitis A Virus-Infection | - | H11N4 subtype | - | H15N9 subtype |
| 6. | Hepatitis B Virus-Infection | - | H11N6 subtype | - | H16N3 subtype |
| 7. | Hepatitis C Virus-Infection | - | H11N8 subtype | - | H1N1 subtype |
| 8. | Hepatitis D Virus-Infection | - | H11N9 subtype | - | H1N2 subtype |
| 9. | Hepatitis E Virus-Infection | - | H12N1 subtype | - | H1N3 subtype |
| 10. | Hepatitis G Virus-Infection | - | H12N4 subtype | - | H1N6 subtype |
| 11. | Influenza A Virus-Infection | - | H12N5 subtype | - | H1N9 subtype |
| - | H2N1 subtype | - | H7N5 subtype | - | SARS coronavirus A022 |
| - | H2N2 subtype | - | H7N7 subtype | - | SARS coronavirus A030 |
| - | H2N3 subtype | - | H7N8 subtype | - | SARS coronavirus A031 |
| - | H2N5 subtype | - | H8N4 subtype | - | SARS coronavirus AS |
| - | H2N7 subtype | - | H8N5 subtype | - | SARS coronavirus B012 |
| - | H2N8 subtype | - | H9N1 subtype | - | SARS coronavirus B024 |
| - | H2N9 subtype | - | H9N2 subtype | - | SARS coronavirus B029 |
| - | H3N1 subtype | - | H9N3 subtype | - | SARS coronavirus B033 |
| - | H3N2 subtype | - | H9N5 subtype | - | SARS coronavirus B039 |
| - | H3N3 subtype | - | H9N6 subtype | - | SARS coronavirus B040 |
| - | H3N4 subtype | - | H9N7 subtype | - | SARS coronavirus BJ01 |
| - | H3N5 subtype | - | H9N8 subtype | - | SARS coronavirus BJ02 |
| - | H3N6 subtype | - | H9N9 subtype | - | SARS coronavirus BJ03 |
| - | H3N8 subtype | 12. | Influenza B Virus-Infection | - | SARS coronavirus BJ04 |
| - | H4N1 subtype | 13. | Influenza C Virus-Infection | - | SARS coronavirus BJ2232 |
| - | H4N2 subtype | 14. | Human astrovirus | - | SARS coronavirus BJ302 |
| - | H4N3 subtype | 15. | Human norovirus | - | SARS coronavirus C013 |
| - | H4N4 subtype | 16. | Human calicivirus | - | SARS coronavirus C014 |
| - | H4N5 subtype | 17. | Dengue virus group | - | SARS coronavirus C017 |
| - | H4N6 subtype | 18. | Japanese encephalitis virus | - | SARS coronavirus C018 |
| - | H4N8 subtype | | group | - | SARS coronavirus C019 |
| - | H4N9 subtype | 19. | Kokobera virus group | - | SARS coronavirus C025 |
| - | H5N1 subtype | 20. | Modoc virus group | - | SARS coronavirus C028 |
| - | H5N2 subtype | 21. | mosquito-borne viruses | - | SARS coronavirus C029 |
| - | H5N3 subtype | 22. | Ntaya virus group | - | SARS Coronavirus |

TABLE 1-continued

Infectious diseases which can be treated in accordance with the present invention

- H5N4 subtype
- H5N6 subtype
- H5N7 subtype
- H5N8 subtype
- H5N9 subtype
- H6N1 subtype
- H6N2 subtype
- H6N4 subtype
- H6N5 subtype
- H6N6 subtype
- H6N7 subtype
- H6N8 subtype
- H6N9 subtype
- H7N1 subtype
- H7N2 subtype
- H7N3 subtype
- SARS coronavirus cw037
- SARS coronavirus cw049
- SARS coronavirus FRA
- SARS coronavirus Frankfurt 1
- SARS coronavirus GD01
- SARS coronavirus GD03T0013
- SARS coronavirus GD322
- SARS coronavirus GD69
- SARS coronavirus GZ-A
- SARS coronavirus GZ-B
- SARS coronavirus GZ-C
- SARS coronavirus GZ-D
- SARS coronavirus GZ02
- SARS coronavirus GZ0401
- SARS coronavirus GZ0402
- SARS coronavirus GZ0403
- SARS coronavirus GZ43
- SARS coronavirus GZ50
- SARS coronavirus GZ60
- SARS coronavirus HB
- SARS coronavirus HC/SZ/61/03
- SARS coronavirus HGZ8L1-A
- SARS coronavirus HGZ8L1-B
- SARS coronavirus HGZ8L2
- SARS coronavirus HHS-2004
- SARS coronavirus HKU-36871
- SARS coronavirus HKU-39849
- SARS coronavirus HKU-65806
- SARS coronavirus HKU-66078
- SARS coronavirus Hong Kong/03/2003
- SARS coronavirus TW
- SARS coronavirus TW-GD1
- SARS coronavirus TW-GD2
- SARS coronavirus TW-GD3
- SARS coronavirus TW-GD4
- SARS coronavirus TW-GD5
- SARS coronavirus TW-HP1
- SARS coronavirus TW-HP2
- SARS coronavirus TW-HP3
- SARS coronavirus TW-HP4
- SARS coronavirus TW-JC2
- SARS coronavirus TW-KC1
- SARS coronavirus TW-KC3
- SARS coronavirus TW-PH1
- SARS coronavirus TW-PH2
- SARS coronavirus TW-YM1
- SARS coronavirus TW-YM2
- SARS coronavirus TW-YM3
- SARS coronavirus TW-YM4
- SARS coronavirus TW1

23. Rio Bravo virus group
24. Seaborne tick-borne virus group
25. Spondweni virus group
26. tick-borne encephalitis virus group
27. Yaounde virus
28. Yellow fever virus group
29. GB virus A
30. GBV-C/HGV group
31. Hepatitis GB virus B
32. Marmoset hepatitis GB virus A
33. Human coronavirus
    - SARS coronavirus A001
    - SARS coronavirus A013
    - SARS coronavirus A021
    - SARS coronavirus HPZ-2003
    - SARS coronavirus HSR 1
    - SARS coronavirus HSZ-A
    - SARS coronavirus HSZ-Bb
    - SARS coronavirus HSZ-Bc
    - SARS coronavirus HSZ-Cb
    - SARS coronavirus HSZ-Cc
    - SARS coronavirus HSZ2-A
    - SARS coronavirus HZS2-Bb
    - SARS coronavirus HZS2-C
    - SARS coronavirus HZS2-D
    - SARS coronavirus HZS2-E
    - SARS coronavirus HZS2-Fb
    - SARS coronavirus HZS2-Fc
    - SARS coronavirus JMD
    - SARS coronavirus LC1
    - SARS coronavirus LC2
    - SARS coronavirus LC3
    - SARS coronavirus LC4
    - SARS coronavirus LC5
    - SARS coronavirus LLJ-2004
    - SARS coronavirus NS-1
    - SARS coronavirus PC4-115
    - SARS coronavirus PC4-127
    - SARS coronavirus PC4-13
    - SARS coronavirus PC4-136
    - SARS coronavirus PC4-137
    - SARS coronavirus PC4-145
    - SARS coronavirus PC4-199
    - SARS coronavirus PC4-205
    - SARS coronavirus PC4-227
    - SARS coronavirus PC4-241
    - SARS coronavirus PUMC01
    - SARS coronavirus PUMC02
    - SARS coronavirus PUMC03
    - SARS coronavirus sf098
    - SARS coronavirus sf099
    - SARS coronavirus ShanghaiQXC1
    - SARS coronavirus ShanghaiQXC2
    - SARS coronavirus WHU
    - SARS coronavirus xw002
    - SARS coronavirus ZJ01
    - SARS coronavirus ZJ02
    - SARS coronavirus ZJ0301
    - SARS coronavirus ZMY 1
    - SARS coronavirus ZS-A
    - SARS coronavirus ZS-B
    - SARS coronavirus ZS-C
34. Theiler's encephalomyelitis virus
35. Human enterovirus A
36. Enterovirus 5666/sin/002209
37. Enterovirus 5865/sin/000009
38. Human coxsackievirus A10
39. Human coxsackievirus A12
40. Human coxsackievirus A14
41. Human coxsackievirus A16
42. Human coxsackievirus A2
43. Human coxsackievirus A3

CDC#200301157
- SARS coronavirus civet007
- SARS coronavirus civet010
- SARS coronavirus civet014
- SARS coronavirus civet019
- SARS coronavirus civet020
- SARS coronavirus CUHK-AG01
- SARS coronavirus CUHK-AG02
- SARS coronavirus CUHK-AG03
- SARS coronavirus CUHK-L2
- SARS coronavirus CUHK-Su10
- SARS coronavirus CUHK-W1
- SARS coronavirus Shanhgai LY
- SARS coronavirus Sin0409
- SARS coronavirus Sin2500
- SARS coronavirus Sin2677
- SARS coronavirus Sin2679
- SARS coronavirus Sin2748
- SARS coronavirus Sin2774
- SARS coronavirus Sin3408
- SARS coronavirus Sin3408L
- SARS coronavirus Sin3725V
- SARS coronavirus Sin3765V
- SARS coronavirus Sin842
- SARS coronavirus Sin845
- SARS coronavirus Sin846
- SARS coronavirus Sin847
- SARS coronavirus Sin848
- SARS coronavirus Sin849
- SARS coronavirus Sin850
- SARS coronavirus Sin852
- SARS coronavirus Sin__WNV
- SARS coronavirus Sino1-11
- SARS coronavirus Sino3-11
- SARS coronavirus SinP1
- SARS coronavirus SinP2
- SARS coronavirus SinP3
- SARS coronavirus SinP4
- SARS coronavirus SinP5
- SARS coronavirus SoD
- SARS coronavirus SZ1
- SARS coronavirus SZ13
- SARS coronavirus SZ16
- SARS coronavirus SZ3
- SARS coronavirus Taiwan
- SARS coronavirus Taiwan JC-2003
- SARS coronavirus Taiwan TC1
- SARS coronavirus Taiwan TC2
- SARS coronavirus Taiwan TC3
- SARS coronavirus TJF
- SARS coronavirus Tor2

65. Human coxsackievirus B6
66. Human echovirus 1
67. Human echovirus 11
68. Human echovirus 12
69. Human echovirus 13
70. Human echovirus 14
71. Human echovirus 15
72. Human echovirus 16
73. Human echovirus 17
74. Human echovirus 18
75. Human echovirus 19
76. Human echovirus 2
77. Human echovirus 20
78. Human echovirus 21
79. Human echovirus 24
80. Human echovirus 25
81. Human echovirus 26
82. Human echovirus 27
83. Human echovirus 29
84. Human echovirus 3

TABLE 1-continued

| Infectious diseases which can be treated in accordance with the present invention |
|---|
| - SARS coronavirus TW10 |
| - SARS coronavirus TW11 |
| - SARS coronavirus TW2 |
| - SARS coronavirus TW3 |
| - SARS coronavirus TW4 |
| - SARS coronavirus TW5 |
| - SARS coronavirus TW6 |
| - SARS coronavirus TW7 |
| - SARS coronavirus TW8 |
| - SARS coronavirus TW9 |
| - SARS coronavirus TWC |
| - SARS coronavirus TWC2 |
| - SARS coronavirus TWC3 |
| - SARS coronavirus TWH |
| - SARS coronavirus TWJ |
| - SARS coronavirus TWK |
| - SARS coronavirus TWS |
| - SARS coronavirus TWY |
| - SARS coronavirus Urbani |
| - SARS coronavirus Vietnam |
| - SARS coronavirus WH20 |
| 44. Human coxsackievirus A4 |
| 45. Human coxsackievirus A5 |
| 46. Human coxsackievirus A6 |
| 47. Human coxsackievirus A7 |
| 48. Human coxsackievirus A8 |
| 49. Human enterovirus 71 |
| 50. Human enterovirus 76 |
| 51. Human enterovirus 89 |
| 52. Human enterovirus 90 |
| 53. Human enterovirus 91 |
| 54. Human enterovirus B |
| 55. Enterovirus 69 |
| 56. Enterovirus 74 |
| 57. Enterovirus CA55-1988 |
| 58. Enterovirus Yanbian 96-83csf |
| 59. Human coxsackievirus A9 |
| 60. Human coxsackievirus B1 |
| 61. Human coxsackievirus B2 |
| 62. Human coxsackievirus B3 |
| 63. Human coxsackievirus B4 |
| 64. Human coxsackievirus B5 |
| 85. Human echovirus 30 |
| 86. Human echovirus 31 |
| 87. Human echovirus 32 |
| 88. Human echovirus 33 |
| 89. Human echovirus 4 |
| 90. Human echovirus 5 |
| 91. Human echovirus 6 |
| 92. Human echovirus 7 |
| 93. Human echovirus 8 |
| 94. Human echovirus 9 |
| 95. Human enterovirus 69 |
| 96. Human enterovirus 73 |
| 97. Human enterovirus 74 |
| 98. Human enterovirus 75 |
| 99. Human enterovirus 77 |
| 100. Human enterovirus 78 |
| 101. Swine vesicular disease virus |
| 102. Human enterovirus C |
| 103. Human coxsackievirus A1 |
| 104. Human coxsackievirus A11 |
| 105. Human coxsackievirus A13 |
| 106. Human coxsackievirus A15 |
| 107. Human coxsackievirus A11 |
| 108. Human coxsackievirus A18 |
| 109. Human coxsackievirus A19 |
| 110. Human coxsackievirus A20 |
| 111. Human coxsackievirus A21 |
| 112. Human coxsackievirus A22 |
| 113. Human coxsackievirus A24 |
| 114. Human enterovirus D |
| 115. Human enterovirus 68 |
| 116. Human enterovirus 70 |
| 117. Poliovirus |
| 118. Human poliovirus 1 |
| 119. Human poliovirus 2 |
| 120. Human poliovirus 3 |
| 121. Wild poliovirus type 3 |
| 122. Human parechovirus 1 |
| 123. Human parechovirus 2 |
| 124. Human parechovirus 3 |
| 125. Human rhinovirus A |
| 126. Human rhinovirus 10 |
| 127. Human rhinovirus 100 |
| 128. Human rhinovirus 11 |
| 129. Human rhinovirus 12 |
| 130. Human rhinovirus 13 |
| 131. Human rhinovirus 15 |
| 132. Human rhinovirus 16 |
| 133. Human rhinovirus 18 |
| 134. Human rhinovirus 19 |
| 135. Human rhinovirus 1A |
| 136. Human rhinovirus 1B |
| 137. Human rhinovirus 2 |
| 138. Human rhinovirus 20 |
| 139. Human rhinovirus 21 |
| 140. Human rhinovirus 22 |
| 141. Human rhinovirus 23 |
| 142. Human rhinovirus 24 |
| 143. Human rhinovirus 25 |
| 144. Human rhinovirus 28 |
| 145. Human rhinovirus 29 |
| 146. Human rhinovirus 30 |
| 147. Human rhinovirus 31 |
| 148. Human rhinovirus 32 |
| 149. Human rhinovirus 33 |
| 150. Human rhinovirus 34 |
| 151. Human rhinovirus 36 |
| 152. Human rhinovirus 38 |
| 153. Human rhinovirus 39 |
| 154. Human rhinovirus 40 |
| 155. Human rhinovirus 41 |
| 156. Human rhinovirus 43 |
| 157. Human rhinovirus 44 |
| 158. Human rhinovirus 45 |
| 159. Human rhinovirus 46 |
| 160. Human rhinovirus 47 |
| 161. Human rhinovirus 49 |
| 162. Human rhinovirus 50 |
| 163. Human rhinovirus 51 |
| 164. Human rhinovirus 53 |
| 165. Human rhinovirus 54 |
| 166. Human rhinovirus 55 |
| 167. Human rhinovirus 56 |
| 168. Human rhinovirus 57 |
| 169. Human rhinovirus 58 |
| 170. Human rhinovirus 59 |
| 171. Human rhinovirus 60 |
| 172. Human rhinovirus 61 |
| 173. Human rhinovirus 62 |
| 174. Human rhinovirus 63 |
| 175. Human rhinovirus 64 |
| 176. Human rhinovirus 65 |
| 177. Human rhinovirus 66 |
| 178. Human rhinovirus 67 |
| 179. Human rhinovirus 68 |
| 180. Human rhinovirus 7 |
| 181. Human rhinovirus 71 |
| 182. Human rhinovirus 73 |
| 183. Human rhinovirus 74 |
| 184. Human rhinovirus 75 |
| 185. Human rhinovirus 76 |
| 186. Human rhinovirus 77 |
| 187. Human rhinovirus 78 |
| 188. Human rhinovirus 8 |
| 189. Human rhinovirus 80 |
| 190. Human rhinovirus 81 |
| 191. Human rhinovirus 82 |
| 192. Human rhinovirus 85 |
| 193. Human rhinovirus 88 |
| 194. Human rhinovirus 89 |
| 195. Human rhinovirus 9 |
| 196. Human rhinovirus 90 |
| 197. Human rhinovirus 94 |
| 198. Human rhinovirus 95 |
| 199. Human rhinovirus 96 |
| 200. Human rhinovirus 98 |
| 201. Human rhinovirus B |
| 202. Human rhinovirus 14 |
| 203. Human rhinovirus 17 |
| 204. Human rhinovirus 26 |
| 205. Human rhinovirus 27 |
| 206. Human rhinovirus 3 |
| 207. Human rhinovirus 35 |
| 208. Human rhinovirus 37 |
| 209. Human rhinovirus 4 |
| 210. Human rhinovirus 42 |
| 211. Human rhinovirus 48 |
| 212. Human rhinovirus 5 |
| 213. Human rhinovirus 52 |
| 214. Human rhinovirus 6 |
| 215. Human rhinovirus 69 |
| 216. Human rhinovirus 70 |
| 217. Human rhinovirus 72 |
| 218. Human rhinovirus 79 |
| 219. Human rhinovirus 83 |
| 220. Human rhinovirus 84 |
| 221. Human rhinovirus 86 |
| 222. Human rhinovirus 91 |
| 223. Human rhinovirus 92 |
| 224. Human rhinovirus 93 |
| 225. Human rhinovirus 97 |
| 226. Human rhinovirus 99 |
| 227. Human rhinovirus 001 Finland Nov1995 |
| 228. Human rhinovirus 166 Finland Sep1995 |
| 229. Human rhinovirus 253 Finland Sep1994 |
| 230. Human rhinovirus 263 Berlin 2004 |
| 231. Human rhinovirus 317 Finland Aug1996 |
| 232. Human rhinovirus 425 Finland Dec1995 |
| 233. Human rhinovirus 851 Finland Sep1996 |
| 234. Human rhinovirus 864 Finland Sep1996 |
| 248. Human herpesvirus 7-Infection |
| 249. Human herpesvirus 8 (Kaposi's sarcoma-associated herpesvirus)-Infection |
| 250. Human papillomavirus-10 |
| 251. Human papillomavirus type 10 |
| 252. Human papillomavirus type 28 |
| 253. Human papillomavirus type 29 |
| 254. Human papillomavirus type 3 |
| 255. Human papillomavirus type 77 |
| 256. Human papillomavirus type 94 |
| 257. Human papillomavirus-16 |
| 258. Human papillomavirus type 16 |
| 259. Human papillomavirus type 31 |
| 283. Human papillomavirus type 26 |
| 284. Human papillomavirus type 51 |
| 285. Human papillomavirus type 69 |
| 286. Human papillomavirus type 82 |
| 287. Human papillomavirus-32 |
| 288. Human papillomavirus type 32 |
| 289. Human papillomavirus type 42 |
| 290. Human papillomavirus-34 |
| 291. Human papillomavirus type 34 |
| 292. Human papillomavirus type 73 |
| 293. Human papillomavirus-53 |
| 294. Human papillomavirus type 30 |
| 295. Human papillomavirus type 53 |
| 296. Human papillomavirus type 56 |

TABLE 1-continued

Infectious diseases which can be treated in accordance with the present invention 235. Human rhinovirus 928 Finland May1995
236. Human rhinovirus strain Hanks
237. Untyped human rhinovirus OK88-8162
238. Rubella virus
239.
240. Human respiratory syncytial virus A
241. Human respiratory syncytial virus B
242. Human herpesvirus 1 (Herpes simplex)-Infection
243. Human herpesvirus 2-Infection
244. Human herpesvirus 3 (Varicella-zoster virus)-Infection
245. Human herpesvirus 4 (Epstein-Barr virus)-Infection
246. Human herpesvirus 5 (Cytomegalovirus)-Infection
247. Human herpesvirus 6-Infection
260. Human papillomavirus type 33
261. Human papillomavirus type 35
262. Human papillomavirus type 35H
263. Human papillomavirus type 52
264. Human papillomavirus type 58
265. Human papillomavirus type 67
266. Human papillomavirus-18
267. Human papillomavirus-cand85
268. Human papillomavirus type 18
269. Human papillomavirus type 39
270. Human papillomavirus type 45
271. Human papillomavirus type 59
272. Human papillomavirus type 68
273. Human papillomavirus type 70
274. Human papillomavirus-2
275. Human papillomavirus type 2
276. Human papillomavirus type 27
277. Human papillomavirus type 27b
278. Human papillomavirus type 2a
279. Human papillomavirus type 2c
280. Human papillomavirus type 57
281. Human papillomavirus type 57b
282. Human papillomavirus-26
297. Human papillomavirus type 66
298. Human papillomavirus-54
299. Human papillomavirus-6
300. Human papillomavirus type 11
301. Human papillomavirus type 13
302. Human papillomavirus type 44
303. Human papillomavirus type 55
304. Human papillomavirus type 6
305. Human papillomavirus type 6a
306. Human papillomavirus type 6b
307. Human papillomavirus type 6c
308. Human papillomavirus type 6e
309. Human papillomavirus type 6vc
310. Human papillomavirus type 74
311. Pygmy chimpanzee papillomavirus type 1
312. Human papillomavirus - 61
313. Human papillomavirus - 72
314. Human papillomavirus - 81
315. Human papillomavirus - 83
316. Human papillomavirus-cand62
317. Human papillomavirus-cand86
318. Human papillomavirus-cand87
319. Human papillomavirus-cand89
320. Human papillomavirus type 61
321. Human papillomavirus type 84
322. Human papillomavirus-7
323. Human papillomavirus-cand91
324. Human papillomavirus type 40
325. Human papillomavirus type 43
326. Human papillomavirus type 7
327. Human papillomavirus-71
328. Human papillomavirus type 71
329. Human papillomavirus-cand90
330. Human papillomavirus-49
331. Human papillomavirus type 49
332. Human papillomavirus type 75
333. Human papillomavirus type 76
334. Human papillomavirus-5
335. Human papillomavirus type 12
336. Human papillomavirus type 14
337. Human papillomavirus type 14D
338. Human papillomavirus type 19
339. Human papillomavirus type 20
340. Human papillomavirus type 21
341. Human papillomavirus type 25
342. Human papillomavirus type 36
343. Human papillomavirus type 47
344. Human papillomavirus type 5
345. Human papillomavirus type 5b
346. Human papillomavirus type 8
347. Human papillomavirus type 93
348. Human papillomavirus-9
349. Human papillomavirus type 15
350. Human papillomavirus type 17
351. Human papillomavirus type 22
352. Human papillomavirus type 23
353. Human papillomavirus type 37
354. Human papillomavirus type 38
355. Human papillomavirus type 38b
356. Human papillomavirus type 80
357. Human papillomavirus type 9
358. Human papillomavirus-cand92
359. Human papillomavirus type 92
360. Human papillomavirus-cand96
361. Human papillomavirus type 96
362. Human papillomavirus-4
363. Human papillomavirus type 4
364. Human papillomavirus type 65
365. Human papillomavirus type 95
366. Human papillomavirus-48
367. Human papillomavirus type 48
368. Human papillomavirus-50
369. Human papillomavirus type 50
370. Human papillomavirus-60
371. Human papillomavirus type 60
372. Human papillomavirus-1
373. Human papillomavirus type 1a
374. Human papillomavirus-41
375. Human papillomavirus type 41
376. Human papillomavirus-63
377. Human papillomavirus type 63
378. Human papillomavirus HANOA464
379. Human papillomavirus RTRX7
380. Human papillomavirus type 24
381. Human papillomavirus type 64
382. Human papillomavirus type JC9710
383. Human papillomavirus type JC9813
384. Human papillomavirus type JEB2
385. Human papillomavirus type me180
386. Human papillomavirus type Xc
387. Human papillomavirus type Xd
388. Human papillomavirus type Xf
389. Human papillomavirus type Xg
390. Human papillomavirus type Xh
391. BK polyomavirus
392. JC polyomavirus
393. Cowpox virus
394. Monkeypox virus
395. Vaccinia virus
396. Variola major virus
397. Variola minor virus
398. Human orf virus
399. Pseudocowpox virus
400. Mammalian orthoreovirus 1
401. Mammalian orthoreovirus 2
402. Mammalian orthoreovirus 3
403. Mammalian orthoreovirus 4 Ndelle
404. SARS orthoreovirus GD-2003
405. Human rotavirus A
406. Human rotavirus B
407. Human rotavirus C
408. Human rotavirus ADRV-N
409. Human parvovirus B19
410. Adeno-associated virus
411. Adeno-associated virus - 1
412. Adeno-associated virus 6
413. Adeno-associated virus-2
414. Adeno-associated virus 2H
415. Adeno-associated virus-3
416. Adeno-associated virus 3B
417. Adeno-associated virus-4
418. Adeno-associated virus-5
419. Adeno-associated virus-7
420. Adeno-associated virus-8
421. Adeno-associated virus 10
454. Four Corners hantavirus
455. Hantaan virus
456. Hu39694 virus
457. Isla Vista virus
458. Khabarovsk virus
459. Laguna Negra virus
460. Limestone Canyon virus
461. Muleshoe virus
462. New York virus
493. Oriboca virus
494. Oropouche virus
495. Sathuperi virus
496. Shamonda virus
497. Shuni virus
498. Simbu virus
499. Wyeomyia virus
500. Punta Toro virus
501. Rift Valley fever virus TABLE 1-continued Infectious diseases which can be treated in accordance with the present invention 422. Adeno-associated virus 11
423. Adeno-associated virus 12
424. Adeno-associated virus 9
425. Human erythrovirus V9
426. Human erythrovirus VX
427. Simian parvovirus
428. Human parvovirus 4
429. Allpahuayo virus
430. Amapari virus
431. Bear Canyon virus
432. Cupixi virus
433. Flexal virus
434. Guanarito virus
435. Junin virus
436. Latino virus
437. Machupo virus
438. Oliveros virus
439. Parana virus
440. Pichinde virus
441. Pirital virus
442. Sabia virus
443. Tacaribe virus
444. Tamiami virus
445. Whitewater Arroyo virus
446. Lassa virus
447. Amur virus
448. Andes virus
449. Bayou virus
450. Black Creek Canal virus
451. Cano Delgadito virus
452. Dobrava virus
453. El Moro Canyon hantavirus
463. Prairie vole hantavirus
464. Prospect Hill virus
465. Puumala virus
466. Reithrodontomys mexicanus hantavirus
467. Rio Mamore virus
468. Sapporo rat virus
469. Seoul virus
470. Sin Nombre virus
471. Taimyr hantavirus
472. Thailand virus
473. Thottapalayam virus
474. Topografov virus
475. Tula virus
476. Vladivostok virus
477. Crimean-Congo hemorrhagic fever virus
478. Dera Ghazi Khan virus
479. Dugbe virus
480. Hughes virus
481. Qalyub virus
482. Sakhalin virus
483. Thiafora virus
484. Akabane virus
485. Bunyamwera virus
486. California encephalitis virus
487. Caraparu virus
488. Kairi virus
489. Madrid virus
490. Main Drain virus
491. Manzanilla virus
492. Marituba virus
502. Sandfly fever Naples virus
503. Uukuniemi virus
504. Phlebovirus sp.
505. Bornavirus
506. Cote d'Ivoire ebolavirus
507. Ebola virus
508. Reston ebolavirus
509. Sudan ebolavirus
510. Zaire ebolavirus
511. Marburgvirus
512. Avulavirus
513. Henipavirus
514. Morbillivirus
515. Respirovirus
516. Rubulavirus
517. Human parainfluenza virus 1
518. Human parainfluenza virus 3
519. Human parainfluenza virus 2
520. Human parainfluenza virus 4
521. Human parainfluenza virus 4a
522. Human parainfluenza virus 4b
523. Mapuera virus
524. Mumps virus
525. Human metapneumovirus
526. Rabies virus
527. Hirame rhabdovirus
528. Infectious hematopoietic necrosis virus
529. Viral hemorrhagic septicemia virus
530. Sendai virus
531. Human adenovirus A-Infection
532. Human adenovirus type 12-Infection
533. Human adenovirus type 18-Infection
534. Human adenovirus type 31-Infection
535. Simian adenovirus type 10-Infection
536. Simian adenovirus type 11-Infection
537. Simian adenovirus type 14-Infection
538. Simian adenovirus type 2-Infection
539. Simian adenovirus type 4-Infection
540. Simian adenovirus type 6-Infection
541. Simian adenovirus type 9-Infection
542. Human adenovirus B-Infection
543. Human adenovirus 3 + 7-Infection
544. Human adenovirus type 11-Infection
545. Human adenovirus type 11a-Infection
546. Human adenovirus type 11p-Infection
547. Human adenovirus type 14-Infection
548. Human adenovirus type 16-Infection
549. Human adenovirus type 21-Infection
550. Human adenovirus type 3-Infection
551. Human adenovirus type 34-Infection
552. Human adenovirus type 34a-Infection
553. Human adenovirus type 35-Infection
554. Human adenovirus type 35 + 11-Infection
555. Human adenovirus type 35p-Infection
556. Human adenovirus type 50-Infection
557. Human adenovirus type 50 prototype strain Wan-Infection
558. Human adenovirus type 7-Infection
559. Human adenovirus type 7a-Infection
560. Human adenovirus type 7d-Infection
561. Human adenovirus type 7d2-Infection
562. Human adenovirus type 7l-Infection
563. Human adenovirus type 7p-Infection
564. Simian adenovirus 21-Infection
565. Human adenovirus C-Infection
566. Human adenovirus type 1-Infection
567. Human adenovirus type 2-Infection
568. Human adenovirus type 5-Infection
569. Human adenovirus type 6-Infection
570. Simian adenovirus type 13-Infection
571. Human adenovirus D-Infection
572. Human adenovirus 19a-Infection
573. Human adenovirus 19p-Infection
574. Human adenovirus 37-Infection
575. Human adenovirus type 10-Infection
576. Human adenovirus type 13-Infection
577. Human adenovirus type 15-Infection
578. Human adenovirus type 15/H9-Infection
579. Human adenovirus type 17-Infection
580. Human adenovirus type 19-Infection
581. Human adenovirus type 19a-Infection
582. Human adenovirus type 19p-Infection
583. Human adenovirus type 20-Infection
584. Human adenovirus type 22-Infection
585. Human adenovirus type 23-Infection
586. Human adenovirus type 24-Infection
587. Human adenovirus type 25-Infection
588. Human adenovirus type 26-Infection
589. Human adenovirus type 27-Infection
590. Human adenovirus type 28-Infection
591. Human adenovirus type 29-Infection
592. Human adenovirus type 30-Infection
593. Human adenovirus type 32-Infection
594. Human adenovirus type 33-Infection
595. Human adenovirus type 36-Infection
614. Simian adenovirus 22-Infection
615. Simian adenovirus 23-Infection
641. *Listeria ivanovii* subsp. *ivanovii*
642. *Listeria ivanovii* subsp. *londoniensis*

TABLE 1-continued

Infectious diseases which can be treated in accordance with the present invention 596. Human adenovirus type 37-Infection
597. Human adenovirus type 38-Infection
598. Human adenovirus type 39-Infection
599. Human adenovirus type 42-Infection
600. Human adenovirus type 43-Infection
601. Human adenovirus type 44-Infection
602. Human adenovirus type 45-Infection
603. Human adenovirus type 46-Infection
604. Human adenovirus type 47-Infection
605. Human adenovirus type 48-Infection
606. Human adenovirus type 49-Infection
607. Human adenovirus type 51-Infection
608. Human adenovirus type 8-Infection
609. Human adenovirus type 8E-Infection
610. Human adenovirus type 9-Infection
611. Human adenovirus E-Infection
612. Human adenovirus type 4-Infection
613. Human adenovirus type 4a-Infection
616. Simian adenovirus 24-Infection
617. Simian adenovirus 25-Infection
618. Human adenovirus F-Infection
619. Human adenovirus type 40-Infection
620. Human adenovirus type 41-Infection
621. Simian adenovirus type 19-Infection
622. *Mycobacterium africanum*
623. *Mycobacterium bovis*
624. *Mycobacterium canettii*
625. *Mycobacterium microti*
626. *Mycobacterium pinnipedii*
627. *Mycobacterium tuberculosis*
628. *Mycobacterium leprae*
629. *Pneumocystis carinii f.* sp. *macaca*
630. *Pneumocystis carinii f.* sp. *muris*
631. *Pneumocystis carinii f.* sp. *mustelae*
632. *Pneumocystis carinii f.* sp. *oryctolagi*
633. *Pneumocystis carinii f.* sp. *ratti*
634. *Pneumocystis carinii f.* sp. *rattus-quarti*
635. *Pneumocystis carinii f.* sp. *rattus-secundi*
636. *Pneumocystis carinii f.* sp. *rattus-tertii*
637. *Pneumocystis carinii f.* sp. *Suis*
638. *Listeria grayi*
639. *Listeria innocua*
640. *Listeria ivanovii*
643. *Listeria monocytogenes*
644. *Listeria seeligeri*
645. *Listeria welshimeri*
646. *Bacillus anthracis*
647. *Bacillus cereus*
648. *Yersinia pestis*
649. *Mycoplasma adleri*
650. *Mycoplasma agalactiae*
651. *Mycoplasma agassizii*
652. *Mycoplasma alkalescens*
653. *Mycoplasma alligatoris*
654. *Mycoplasma alvi*
655. *Mycoplasma amphoriforme*
656. *Mycoplasma anatis*
657. *Mycoplasma anseris*
658. *Mycoplasma arginini*
659. *Mycoplasma arthritidis*
660. *Mycoplasma auris*
661. *Mycoplasma* BHJA
662. *Mycoplasma bovigenitalium*
663. *Mycoplasma bovirhinis*
664. *Mycoplasma bovis*
665. *Mycoplasma bovoculi*
666. *Mycoplasma buccale*
667. *Mycoplasma buteonis*
668. *Mycoplasma californicum*
669. *Mycoplasma canadense*
670. *Mycoplasma canis*
671. *Mycoplasma capricolum*
672. *Mycoplasma capricolum* subsp. *capricolum*
673. *Mycoplasma capricolum* subsp. *capripneumoniae*
674. *Mycoplasma caviae*
675. *Mycoplasma cavipharyngis*
676. *Mycoplasma citelli*
677. *Mycoplasma cloacale*
678. *Mycoplasma coccoides*
679. *Mycoplasma collis*
680. *Mycoplasma columbinasale*
681. *Mycoplasma columbinum*
682. *Mycoplasma columborale*
683. *Mycoplasma conjunctivae*
684. *Mycoplasma corogypsi*
685. *Mycoplasma cottewii*
686. *Mycoplasma cricetuli*
687. *Mycoplasma crocodyli*
688. *Mycoplasma cynos*
689. *Mycoplasma dispar*
690. *Mycoplasma edwardii*
691. *Mycoplasma elephantis*
692. *Mycoplasma equigenitalium*
693. *Mycoplasma equirhinis*
694. *Mycoplasma falconis*
695. *Mycoplasma fastidiosum*
696. *Mycoplasma faucium*
697. *Mycoplasma felifaucium*
698. *Mycoplasma feliminutum*
699. *Mycoplasma felis*
700. *Mycoplasma fermentans*
701. *Mycoplasma incognitus*
702. *Mycoplasma flocculare*
703. *Mycoplasma gallinaceum*
704. *Mycoplasma gallinarum*
705. *Mycoplasma gallisepticum*
706. *Mycoplasma gallopavonis*
707. *Mycoplasma gateae*
708. *Mycoplasma genitalium*
709. *Mycoplasma glycophilum*
710. *Mycoplasma gypis*
711. *Mycoplasma haemocanis*
712. *Mycoplasma haemofelis*
713. *Mycoplasma haemomuris*
714. *Mycoplasma hominis*
715. *Mycoplasma hyopharyngis*
716. *Mycoplasma hyopneumoniae*
717. *Mycoplasma hyorhinis*
718. *Mycoplasma hyosynoviae*
719. *Mycoplasma iguanae*
720. *Mycoplasma imitans*
721. *Mycoplasma indiense*
722. *Mycoplasma iners*
723. *Mycoplasma iowae*
724. *Mycoplasma lagogenitalium*
725. *Mycoplasma leonicaptivi*
726. *Mycoplasma leopharyngis*
727. *Mycoplasma lipofaciens*
728. *Mycoplasma lipophilum*
729. *Mycoplasma maculosum*
730. *Mycoplasma meleagridis*
731. *Mycoplasma microti*
732. *Mycoplasma moatsii*
733. *Mycoplasma mobile*
734. *Mycoplasma molare*
735. *Mycoplasma monodon*
736. *Mycoplasma muris*
737. *Mycoplasma mustelae*
738. *Mycoplasma mycoides*
739. *Mycoplasma neurolyticum*
740. *Mycoplasma opalescens*
741. *Mycoplasma orale*
742. *Mycoplasma ovipneumoniae*
743. *Mycoplasma ovis*
744. *Mycoplasma oxoniensis*
745. *Mycoplasma penetrans*
746. *Mycoplasma phocicerebrale*
747. *Mycoplasma phocidae*
748. *Mycoplasma phocirhinis*
749. *Mycoplasma pirum*
750. *Mycoplasma pneumoniae*
751. *Mycoplasma pneumophila*
752. *Mycoplasma primatum*
753. *Mycoplasma pullorum*
754. *Mycoplasma pulmonis*
755. *Mycoplasma putrefaciens*
756. *Mycoplasma salivarium*
757. *Mycoplasma simbae*
758. *Mycoplasma spermatophilum*
759. *Mycoplasma spheniscі*
760. *Mycoplasma spumans*
761. *Mycoplasma sturni*
762. *Mycoplasma sualvi*
763. *Mycoplasma subdolum*
764. *Mycoplasma suis*
765. *Mycoplasma synoviae*
766. *Mycoplasma testudineum*
767. *Mycoplasma testudinis*
768. *Mycoplasma timone*
769. *Mycoplasma verecundum*
770. *Mycoplasma vulturii*
771. *Mycoplasma wenyonii*
772. *Mycoplasma yeatsii*
773. *Mycoplasma zalophi*
774. *Toxoplasma gondii*
775. *Chlamydia suis*
776. *Chlamydia trachomatis*
777. Fungal infections A further group of diseases for the treatment and/or prevention of which the CD3 kappa peptides and the nucleic acids coding therefor, respectively, and in particular the CD3 kappa peptide related compounds are used in a preferred embodiment, are those where the surface expression of the TCR is abundant, more particularly higher than expected under normal or non-diseased conditions, or where the surface expression of the TCR is found in lymphocytes in compartments where in the healthy subjects a lower TCR expression can be found. CD3 kappa peptides and the nucleic acids coding therefor, respectively, and in particular the CD3 kappa peptide related compounds are used in the treatment of higher expression of named antiapoptotic and/or proliferation inducing receptors, and/or the named cytokines.

In other words, the CD3 kappa peptides and the nucleic acids coding therefor, respectively, and in particular the CD3 kappa peptide related compounds are used in an embodiment for the treatment and/or prevention of a disease where the increased or prolonged surface expression of the T cell receptor, and/or the antiapoptotic, and/or proliferation inducing receptors recited herein, and/or the cytokines recited herein, gives rise to, is linked to or is associates with a pathological condition which is the respective disease, a pre-stage thereof or which increases the susceptibility of a subject for such disease. Such diseases are preferably autoimmune diseases and more preferably selected from the group comprising the diseases summarized in table 2.

TABLE 2

| Autoimmune disorders which can be treated in accordance with the present Invention | |
|---|---|
| 1. | Takayasu Arteritis |
| 2. | Giant-cell arteritis |
| 3. | familial mediterranean fever |
| 4. | Kawasaki disease |
| 5. | Polyarteritis nodosa |
| 6. | cutanous Polyarteritis nodosa |
| 7. | Hepatitis-associated arteritis |
| 8. | Behcet's syndrome |
| 9. | Wegener's granulomatosis |
| 10. | Churg-Strauss syndrome |
| 11. | microscopic polyangiitis |
| 12. | Vasculitis of connective tissue diseases |
| 13. | Hennoch-Schonlein purpura |
| 14. | Cryoglobulinemic vasculitis |
| 15. | Cutaneous leukocytoclastic angiitis |
| 16. | Tropical aortitis |
| 17. | Sarcoidosis |
| 18. | Cogan's syndrome |
| 19. | Wiskott-Aldrich Syndrome |
| 20. | Lepromatous arteritis |
| 21. | Primary angiitis of the CNS |
| 22. | Thromboangiitis obliterans |
| 23. | Paraneoplastic ateritis |
| 24. | Urticaria |
| 25. | Dego's disease |
| 26. | Myelodysplastic syndrome |

TABLE 2-continued

| Autoimmune disorders which can be treated in accordance with the present Invention | |
|---|---|
| 27. | Eythema elevatum diutinum |
| 28. | Hyperimmunoglobulin D |
| 29. | Allergic Rhinitis |
| 30. | Asthma bronchiale |
| 31. | chronic obstructive pulmonary disease |
| 32. | periodontitis |
| 33. | Rheumatoid Arthritis |
| 34. | atherosclerosis |
| 35. | Amyloidosis |
| 36. | Morbus Chron |
| 37. | Colitis ulcerosa |
| 38. | Autoimmune Myositis |
| 39. | Diabetes mellitus |
| 40. | Multiple sclerosis |
| 41. | Guillain-Barre Syndrome |
| 42. | histiocytosis |
| 43. | Osteoarthritis |
| 44. | atopic dermatitis |
| 45. | periodontitis |
| 46. | chronic rhinosinusitis |
| 47. | Psoriasis |
| 48. | psoriatic arthritis |
| 49. | Microscopic colitis |
| 50. | Pulmonary fibrosis |
| 51. | glomerulonephritis |
| 52. | Whipple's disease |
| 53. | Still's disease |
| 54. | erythema nodosum |
| 55. | otitis |
| 56. | cryoglobulinemia |
| 57. | Sjogren's syndrome |
| 58. | Lupus erythematosus |
| 59. | aplastic anemia |
| 60. | Osteomyelofibrosis |
| 61. | chronic inflammatory demyelinating polyneuropathy |
| 62. | Kimura's disease |
| 63. | systemic sclerosis |
| 64. | chronic periaortitis |
| 65. | chronic prostatitis |
| 66. | idiopathic pulmonary fibrosis |
| 67. | chronic granulomatous disease |
| 68. | Idiopathic achalasia |
| 69. | bleomycin-induced lung inflammation |
| 70. | cytarabine-induced lung inflammation |
| 71. | Autoimmunthrombozytopenia |
| 72. | Autoimmunneutropenia |
| 73. | Autoimmunhemolytic anemia |
| 74. | Autoimmunlymphocytopenia |
| 75. | Chagas' disease |
| 76. | chronic autoimmune thyroiditis |
| 77. | autoimmune hepatitis |
| 78. | Hashimoto's thyroiditis |
| 79. | atropic thyroiditis |
| 80. | Graves disase |
| 81. | Autoimmune polyglandular syndrome |
| 82. | Autoimmune Addison Syndrome |
| 83. | Pemphigus vulgaris |
| 84. | Pemphigus foliaceus |
| 85. | Dermatitis herpetiformis |
| 86. | Autoimmune alopecia |
| 87. | Vitiligo |

TABLE 2-continued

| Autoimmune disorders which can be treated in accordance with the present Invention | |
|---|---|
| 88. | Antiphospholipid syndrome |
| 89. | Myasthenia gravis |
| 90. | Stiff-man syndrome |
| 91. | Goodpasture's syndrome |
| 92. | Sympathetic ophthalmia |
| 93. | Folliculitis |
| 94. | Sharp syndrome |
| 95. | Evans syndrome |

It will be acknowledged by the one skilled in the art that particularly those diseases where the T cell receptor surface expression is to be reduced for achieving a therapeutically beneficial effect, CD3 kappa peptide related compounds can be advantageously used, whereby such CD3 kappa peptide related compounds are targeting or interacting wild type CD3 kappa peptide, preferably the CD3 kappa peptide according to SEQ ID NO:4, and any nucleic acids coding therefor. Such compounds are preferably selected from the group comprising small molecules, antibodies, high affinity binding peptides, anticalines, aptamers, spiegelmers, antisense-nucleic acids, ribozymes and RNAi molecules which are described herein in more detail.

The use of the CD3 kappa peptide and the nucleic acids coding therefor, for this kind of disease is, in principle, also possible under the proviso that the administration of an analogue of CD3 kappa or a nucleic acid coding therefor results in the blocking of the physiologically present CD3 kappa peptide. Preferably such analogue has an amino acid sequence according to SEQ ID NOs. 5-4437. A possible explanation for this effect is competitive inhibition. In connection therewith particularly those derivatives of CD3 kappa peptides are advantageous and can be advantageously used which do not have one, preferably more and most preferably all of the characteristics of the CD3 kappa peptide having the amino acid sequence according to SEQ ID NO:4.

Additionally, the diseases which can be addressed, i.e. treated or prevented, by either using the CD3 kappa peptides and nucleic acids coding therefor such as by, e.g., the aforementioned mechanism of competitive inhibition, or by the CD3 kappa peptide related compounds, may also be defined by the further effects of CD3 kappa, in particular the effect of the CD3 kappa peptide having amino acid sequence according to SEQ ID NO:4. This is based on the further surprising finding of the present inventors that an increased titre of CD3 kappa having the amino acid sequence according to SEQ ID NO:4 goes along with or is associated with an increased expression of CD4, CD2, CD25, CD116, CD127, CCR5, CCR9, CXCR1, CXCR3, EGF, Eotaxin-2, I-309, IFN-gamma, IL-1alpha, IL-1 beta, IL-3, IL-6, NAP-2, TGF-beta3, and PARC. Preferably, the increase in the expression of CD4, CD2, CD25, CD116, CD127, CCR5, CCR9, CXCR1, CXCR3 after CD3 kappa peptide treatment, preferably within 48 hours, by at least a factor of 50%, more preferably by at least 100% and even more preferably by at least 200%. The increase in the expression of the proinflammatory cytokines and chemokines EGF, Eotaxin-2, I-309, IL-1β, IL-3, IL-6, NAP-2, TGFβ3 and PARC after CD3 kappa peptide treatment, preferably within 48 hours, is by at least a factor of 50%, more preferably at least 100% and even more preferably at least 200%. The increase in the expression of IL-1α and IFNγ after CD3 kappa peptide treatment, preferably within 48 hours, is by at least a factor of 100%, more preferably at least 200% and even more preferably at least 500%.

More specifically, any disease which goes along with the decreased expression of these proteins can thus be prevented and/or treated using the CD3 kappa peptide and the respective nucleic acid coding therefor. The particular diseases to be thus treated or prevented can be more specifically taken from the mode of action of any of these cytokines and chemokines. Accordingly, as outlined above, all infections caused by or associated with viruses or intracellular pathogens as those listed in table 1 can be treated with CD3 kappa peptides or nucleic acids coding therefor. The following table 3 summarized some of the diseases which can accordingly be treated and prevented, respectively.

TABLE 3

| Further diseases which can be treated using CD3 kappa peptides and nucleic acids coding therefor (in addition to table 1). | |
|---|---|
| 1. | Chronic granulomatous disease |
| 2. | Chediak-Higashi syndrome |
| 3. | Leukocyte adhesion defect |
| 4. | Complement deficiencies |
| 5. | NK cell defect |
| 6. | X-linked hyper-IgM syndrome |
| 7. | Common variable immunodeficiency |
| 8. | Selective IgA deficiency |
| 9. | X-linked agammaglobulinemia (XLA) |
| 10. | Wiskott-Aldrich Syndrome |
| 11. | Bare lymphocyte syndrome (Class I) |
| 12. | Bare lymphocyte syndrome (Class II) |
| 13. | DiGeorge's syndrome |
| 14. | Severe Combined Immune Deficiency (SCID) |
| 15. | X-linked lymphoproliferative syndrome |
| 16. | Ataxia telangiectasia |
| 17. | Bloom's syndrome |
| 18. | Zap-70 deficiency |
| 19. | Purine nucleoside phosphorylase (PNP) deficiency |
| 20. | Nezelof syndrome |
| 21. | CD3ε and CD3γ deficiencies |
| 22. | Omenn syndrome |
| 23. | Reticular dysgenesis |
| 24. | Adenosine deaminase (ADA) deficiency |
| 25. | JAK3 deficiency |
| 26. | TAP2 deficiency |
| 27. | CIITA, RFX, and RFXAP deficiencies |
| 28. | Fanconi anaemia |
| 29. | Xeroderma pigmentosum |
| 30. | Nijmegen breakage syndrome |

It will also be acknowledged by the ones skilled in the art that some of the diseases mediated through or associated with these cytokines, chemokines or the said receptors, may be identical to or overlapping to the specific diseases disclosed herein. However, in any case such diseases will be obvious to the one skilled in the art in the light of the present disclosure.

In a similar way as the inventors defined above the characteristics of what is preferably understood herein by the term "decreased expression of the TCR" and the capability of the CD3 kappa peptides and nucleic acids coding therefor to normalize and/or increase the expression thereof, particularly in connection with the various diseases related thereto and as disclosed herein, this can also be done to show the beneficial effect in regards to the expression of the proinflammatory cytokines and chemokines, and of the said receptors going along with such decreased expression of the TCR as disclosed herein.

Insofar, the difference in expression between patients and healthy subjects should preferably be the mean value of the expression of the said proinflammatory cytokines and chemokines, and of the said receptors of the healthy subjects plus three times the standard deviation, or should also possibly be congruent to statistical hypothesis testing with a p-value of or below 0.05, making the difference statistically significant.

Also using this criterion, the present inventors have found that the expression of the said proinflammatory cytokines and chemokines, and of the respective said receptors in the leukocytes in the patient populations described herein can be increased by CD3 kappa peptides, its derivatives and nucleic acids coding therefor to normal values as defined by healthy individuals.

Additionally, the diseases which can be addressed, i.e. treated or prevented, by either using the CD3 kappa peptides and nucleic acids coding therefor, may also be defined by the further effects of CD3 kappa disclosed herein, in particular the effect of the CD3 kappa peptide having amino acid sequence according to SEQ ID NO:4 residing in the decrease of the expression of a compound selected from the group comprising CD58, IL-1ra, IL-8, RANTES, SDF-1, TARC, MCP-4, GRO, soluble IL-6 receptor and soluble TNF-receptor II. This is based on the further surprising finding of the present inventors that an increased titre of CD3 kappa having the amino acid sequence according to SEQ ID NO:4 goes along with or is associated with a decreased expression of CD58, IL-1ra, IL-8, RANTES, SDF-1, TARC, MCP-4, GRO, soluble IL-6 receptor and soluble TNF-receptor II. More specifically, any disease which goes along with an increased expression of CD58, IL-1ra, IL-8, RANTES, SDF-1, TARC, MCP-4, GRO, soluble IL-6 receptor and soluble TNF-receptor II, respectively can thus be prevented and/or treated using the CD3 kappa peptides and the respective nucleic acid coding therefor. The decrease in the expression of those factors after CD3 kappa peptide treatment, preferably within 48 hours, is by at least a factor of 50%, more preferably at least 100% and even more preferably at least 200%. The particular diseases to be thus treated or prevented can be more specifically taken from the mode of action of any of these cytokines and chemokines and is, for example disclosed in Table 2 summarized some of the diseases which can accordingly be treated and prevented, respectively.

It will also be acknowledged by the ones skilled in the art that some of the diseases mediated through or associated with these cytokines and chemokines, respectively, may be identical to or overlapping to the specific diseases disclosed herein, however, in any case such diseases will be obvious to the one skilled in the art in the light of the present disclosure.

In the same way as the inventors defined above the characteristics of what is preferably understood herein by the term "decreased expression of the TCR" and the capability of the CD3 kappa peptides and nucleic acids coding therefor to normalize and/or increase the expression thereof, particularly in connection with the various diseases related thereto and as disclosed herein, this can also be done to show the beneficial effect in regards to the expression of the said cytokines and chemokines, and of CD58.

Insofar, the difference in expression between patients and healthy subjects should preferably be the mean value of the expression of the said cytokines and chemokines, and of CD58 of the healthy subjects plus three times the standard deviation, or should also possibly be congruent to statistical hypothesis testing with a p-value of or below 0.05, making the difference statistically significant.

Also having used this criterion, the present inventors have found that the expression of the said cytokines and chemokines, and of CD58 in the leukocytes in the patient populations described herein can be decreased by CD3 kappa peptides, its derivatives and nucleic acids coding therefor.

As disclosed herein the CD3 kappa peptides and the nucleic acids coding therefor, will be suitable to increase the TCR surface expression status of a patient and of a healthy subject. Insofar, any medicament comprising at least one of the CD3 kappa peptides and/or at least one of the nucleic acids coding therefor, can be used for restoring the immune status of a patient or subject, preferably healthy subject, also referred to herein together as person. Such person may be a person who has been, is or will be undergoing a treatment which results or may result in depletion of T cells and more specifically surface expression of the T cell receptor. This kind of person may thus be a person which has, is or will be undergoing chemotherapy, therapy with biologicals as antibodies, cytokines or other recombinant proteins, and radiation therapy, respectively. Another group of persons to which the CD3 kappa peptides and the nucleic acids coding therefor or any medicament or pharmaceutical composition comprising the same may or will be administered, is thus any person suffering from or being at the risk of suffering from a reduction or depletion of T cell receptor expression, whereby such reduced T cell receptor expression preferably results from a disease or a genetic disorder. Such genetic disorders are for example included in Table 3.

Again without wishing to be bound by any theory, the present inventors assume that CD3 kappa having the amino acid sequence according to SEQ ID NO:4 is suitable to direct T cells to secrete cytokines congruent to a $TH_0$ or $TH_1$ profile rather than to a $TH_2$ profile. Insofar, the use of the CD3 kappa peptides and the nucleic acids coding therefor, is also suitable in the prevention and/or treatment of any disease which is characterized by or can be prevented and/or treated by increasing the $TH_1$ response of a person, preferably a patient. Insofar, the CD3 kappa peptides and the nucleic acids coding therefor, can be used in vaccination. It is thus also within the present invention that the CD3 kappa peptides and the nucleic acids coding therefor, are used either alone or in combination as adjuvants.

It is within the present invention that any of the medicament and pharmaceutical composition, respectively, described herein comprising at least one of the pharmaceutically active compound according to the present invention herein may be used for the treatment and/or prevention of a diseases, preferably any of the diseases disclosed herein.

As preferably used herein, the term pharmaceutically active compound according to the present invention comprises one of the compounds selected from the group comprising CD3 kappa peptides, nucleic acids coding therefor and CD3 kappa peptide related compounds, whereby such CD3 kappa peptide related compounds also comprise small molecules. Preferably, as used herein, small molecules are molecules which are pharmaceutically active and fulfil the Lepinsky rules of five and, additionally and/or alternatively have a molecular weight of 1000 or less.

Apart from being used as ingredient of a pharmaceutical composition or for the manufacture of a medicament, particularly the CD3 kappa peptide related compounds are used in a preferred embodiment as diagnostics or means for diagnostic. This use of the CD3 kappa related compounds is based on the finding that CD3 kappa is overexpressed in connection with those diseases specified above. Insofar, these CD3 kappa related compounds are preferably useful in the diagnostic of diseases going along with an increased CD3 kappa peptide titre, preferably an increased titre of CD3 kappa having an amino acid sequence according to SEQ ID NO:4, or an increased transcription and/or translation of a nucleic acid sequence coding for CD3 kappa having the amino acid sequence according to SEQ ID NO:4.

When used as diagnostics the CD3 kappa peptide related compounds are either labelled so as to allow the detection thereof, or are further reacted with another compound detecting the CD3 kappa peptide related compound, preferably the CD3 kappa peptide related compound is complexed with either CD3 kappa, preferably CD3 kappa having the amino acid sequence according to SEQ ID NO:4, or a nucleic acid coding therefor. Preferably said another compound comprises a label or is adapted to allow the detection thereof.

It is within the present invention that in a preferred embodiment the terms disease and disorder are used in an interchangeable manner, if not indicated to the contrary.

It is also within the present invention that the pharmaceutically active compounds according to the present invention may be used for the treatment of a person or a patient suffering from a disease or diseased condition as defined above. Such treatment comprises the administration of one or several of the compounds according to the present invention or a medicament or pharmaceutical composition described herein. Preferably, the person is a mammal and most preferably a human being. In a further embodiment the person is in need of such treatment.

Depending on the specific conditions, disease or disorder to be treated, such pharmaceutically active compounds may be formulated and administrated systemically or locally. Techniques for formulation and administration may be found in "Remington's Pharmaceutical Sciences", 1990, $18^{th}$ ed., Mack Publishing Co., Easton, Pa. The administration of such pharmaceutically active compound according to the present invention can be done in a variety of ways, including, but not limited to, orally, subcutaneously, intravenously, intranasally, transdermally, intraperitoneally, intramuscularly, intrapulmonary, vaginally, rectally, or intraocularly, periocularly, intraorbitally, intracapsulary, intrasynovially, intracisternally, topically, just to name a few. In some instances, for example, in the treatment of wounds and inflammation, the compound according to the present invention may be directly applied as a ointment, powder, solution or spray. Topical administration also comprises passive or facilitated adsorption, preferably through the skin, including skin patches and ionophoresis.

In an embodiment of the various aspects of the present invention, a pharmaceutically active compound according to the present invention is administered together with a further pharmaceutically active compound.

Apart from being a potential drug itself, the CD3 kappa peptides and the nucleic acids coding therefor may be used as the compound against which chemical compounds may be used as drugs or drug candidates or as diagnostic agents, are directed. These chemical compounds belong to different classes of compounds such as antibodies, peptides, anticalines, aptamers, spiegelmers, ribozymes, antisense oligonucleotides and siRNA as well as small molecules which are also referred to herein in their entity as CD3 kappa peptide related compounds. The compounds are designed, selected, screened generated and/or manufactured by either using the CD3 kappa peptides and the nucleic acids coding therefor themselves as a physical or chemical entity, or information related to the CD3 kappa peptides and the nucleic acids coding therefor. Albeit it is referred to herein in the following mostly to the CD3 kappa peptides and the nucleic acids coding therefor in their entirety, it will be understood by the ones skilled in the art that preferably the CD3 kappa peptide having or comprising the amino acid sequence according to SEQ ID NO:4 and the nucleic acid(s) coding therefor will be the target(s) and, respectively, that the various classes of compounds will be addressing and interacting, respectively, with the CD3 kappa peptide having or comprising the amino acid sequence according to SEQ ID NO:4 and the nucleic acid(s) coding therefor. In the design, selection, screening, generation and/or manufacturing process of said classes of compounds the CD3 kappa peptides and the nucleic acids coding therefor will also be referred to as the target which is used in the process rather than in the final application of the respective compound to a patient in need thereof. In the processes which provide the various classes of compounds, either the CD3 kappa peptides or the nucleic acids coding therefor may be used. The term CD3 peptides as used herein comprises any fragment or derivative of the CD3 kappa peptide as disclosed herein which allows the design, selection, screening, generation and/or manufacture of said classes of compounds of the respective class(es) of compounds which in turn are/is upon their/its application as a medicament or as a diagnostic agent active as such. The term nucleic acid coding for the CD3 kappa peptides as used herein in connection with the CD3 kappa peptide related compounds shall comprise any nucleic acid which contains a nucleic acid which codes for the CD3 kappa peptides as defined above and herein, or a part thereof. A part of a nucleic acid coding for the CD3 kappa peptides is regarded as such as long as it is still suitable for the design, selection, screening, generation and/or manufacture of said classes of compounds which in turn are/is upon their/its application as a medicament or as a diagnostic agent active as such. The nucleic acid coding for the CD3 kappa peptides can be genomic nucleic acid, hnRNA, mRNA, cDNA or part of each thereof.

As outlined above it is within the present invention that apart from the CD3 kappa peptides or a part or derivative thereof or a nucleic acid sequence coding therefor, as described herein, also other means or compounds may be used in order to create or to suppress the effects arising from the CD3 kappa peptide having the amino acid sequence according to SEQ ID NO:4 or the nucleic acid coding therefor. Such means may be determined or selected in a screening method. In such screening method a first step is to provide one or several so called candidate compounds. Candidate compounds as used herein are compounds the suitability of which is to be tested in a test system for treating or alleviating the various diseases as described herein and diseased conditions as described herein or to be used as a diagnostic means or agent for this kind of diseases and diseased conditions. If a candidate compound shows a respective effect in a test system said candidate compound is a suitable means or agent for the treatment of said diseases and diseased conditions and, in principle, as well a suitable diagnostic agent for said diseases and diseased conditions. In a second step the candidate compound is contacted with a CD3 kappa peptides expression system or a CD3 kappa peptides gene product, preferably a respective gene expression product, such as a hnRNA or mRNA coding for CD3 kappa having an amino acid sequence according the SEQ ID NO:4, or a CD3 kappa peptides activity system or one of the CD3 kappa peptides, preferably the CD3 kappa having an amino acid sequence according to SEQ ID NO:4. The CD3 kappa peptides activity system is also referred to herein as and/or is preferably also active in the meaning of a system detecting the activity of a CD3 kappa peptides, more preferably of CD3 kappa having an amino acid sequence according to SEQ ID NO:4.

An expression system for CD3 kappa peptides is basically an expression system which shows or displays the expression of one of the CD3 kappa peptides, preferably of CD3 kappa having an amino acid sequence according to SEQ ID NO:4, whereby the extent or level of expression basically may be changed. Preferably, a CD3 kappa peptides activity system is essentially an expression system, whereby the activity or condition of activity is measured rather than the expression of a CD3 kappa peptide. Alternatively, a CD3 kappa peptide activity system is a CD3 kappa peptide system whereby the activity of such CD3 kappa peptide can be measured, or a system providing or comprising a CD3 kappa peptide. In any of these systems it is tested whether under the influence of a candidate compound the activity of a CD3 kappa peptide and more preferably of CD3 kappa having the amino acid sequence according to SEQ ID NO:4 or of the nucleic acid coding therefor, is different from the situation without the candidate compound. Regardless whether the particular system is either an expression system or an activity system, it is within the scope of the present invention that either an increase or a decrease of the activity and expression, respectively, may occur and be measured. Preferably, the expression system and/or activity system is an in vitro reaction using sub-cellular means, such as a cell extract or a fraction of the cell extract such as a nucleus extract. A CD3 kappa peptide expression system as used herein may also be a cell, preferably a cell of a tissue or organ involved in the diseases as described herein and diseased conditions as described herein.

Whether there is an increase or decrease in the activity system or expression system, may be determined at each level of the expression, for example by measuring the increase or decrease of the amount of nucleic acid coding for a CD3 kappa peptides, preferably CD3 kappa having an amino acid sequence according to SEQ ID NO:4, more particularly mRNA or the increase or decrease of a CD3 kappa peptide, preferably CD3 kappa having an amino acid sequence according to SEQ ID NO:4 expressed under the influence of the candidate compound. The techniques required for the measurement, more particularly the quantitative measurement of this kind of changes, such as for the mRNA or the protein are known to the one skilled in the art. Also known to the one skilled in the art are methods to determine the amount of or content of CD3 kappa peptides, preferably CD3 kappa having an amino acid sequence according to SEQ ID NO:4, e.g. by the use of appropriate antibodies. Antibodies may be generated as known to the one skilled in the art and described, e.g. by Harlow, E., and Lane, D., "Antibodies: A Laboratory Manual," Cold Spring Harbor Laboratory, Cold Spring Harbor, N.Y., (1988).

In case of a CD3 kappa peptide expression system, whereby preferably the CD3 kappa peptide is CD3 kappa having an amino acid sequence according to SEQ ID NO:5, an increase or decrease of the activity of a CD3 kappa peptide, preferably CD3 kappa having an amino acid sequence according to SEQ ID NO:4 may be determined, preferably in a functional assay.

Contacting the candidate compound and the expression system and activity system, respectively, is usually performed by adding an aqueous solution of the candidate compound to a respective reaction system which is generally referred to herein as test system. Besides aqueous solutions also suspensions or solutions of the candidate compound in organic solvents may be used. The aqueous solution is preferably a buffer solution.

Preferably, in each run using the expression system and activity system, respectively, only a single candidate compound is used. However, it is also within the present invention that several of these tests are performed in parallel in a high throughput system.

A further step in the method according to the present invention resides in determining whether under the influence of the candidate compound the expression or activity of the expression system and activity system, respectively, in relation to a CD3 kappa peptide, preferably CD3 kappa having an amino acid sequence according to SEQ ID NO:4 or a nucleic acid coding therefore, is changed. Typically this is done by comparing the system's reaction upon addition of the candidate compound relative to the one without addition of the candidate compound. Preferably, the candidate compound is a member of a library of compounds.

Basically any library of compounds is suitable for the purpose of this invention regardless of the class of compounds. Suitable libraries of compounds are, among others, libraries composed of small molecules, of peptides, proteins, antibodies, anticalines and functional nucleic acids. The latter compounds may be generated as known to the one skilled in the art and outlined herein.

The manufacture of an antibody specific for the a CD3 kappa peptides having an amino acid or for the nucleic acids coding therefore, is known to the one skilled in the art and, for example, described in Harlow, E., and Lane, D., "Antibodies: A Laboratory Manual," Cold Spring Harbor Laboratory, Cold Spring Harbor, N.Y., (1988). Preferably, monoclonal antibodies may be used in connection with the present invention which may be manufactured according to the protocol of Köhler and Milstein and further developments based thereon. Antibodies as used herein include, but are not limited to, complete antibodies, antibody fragments or derivatives such as Fab fragments, Fc fragments and single-stranded antibodies, as long as they are suitable and capable of binding to the CD3 kappa peptides. Apart from monoclonal antibodies also polyclonal antibodies may be used and/or generated. The generation of polyclonal antibodies is also known to the one skilled in the art and, for example, described in Harlow, E., and Lane, D., "Antibodies: A Laboratory Manual," Cold Spring Harbor Laboratory, Cold Spring Harbor, N.Y., (1988). Preferably, the antibodies used for therapeutical purposes are humanized or human antibodies as defined above.

The antibodies which may be used according to the present invention may have one or several markers or labels. Such markers or labels may be useful for detecting the antibody either in its diagnostic application or its therapeutic application. Preferably the markers and labels are selected from the group comprising avidine, streptavidine, biotin, gold and fluorescein and used, e.g., in ELISA methods. These and further markers as well as methods are, e.g., described in Harlow, E., and Lane, D., "Antibodies: A Laboratory Manual," Cold Spring Harbor Laboratory, Cold Spring Harbor, N.Y., (1988).

It is also within the present invention that the label or marker exhibits an additional function apart from detection, such as interaction with other molecules. Such interaction may be, e.g., specific interaction with other compounds. These other compounds may either be those inherent to the system where the antibody is used such as the human or animal body or the sample which is analyzed by using the respective antibody. Appropriate markers may, for example, be biotin or fluoresceine with the specific interaction partners thereof such as avidine and streptavidine and the like being present on the respective compound or structure to interact with the thus marked or labelled antibody.

Further classes of medicaments as well as diagnostic agents which may be generated using the CD3 kappa peptides or the nucleic acid coding therefor, are peptides which bind thereto. Such peptides may be generated by using methods according to the state of the art such as phage display. Basically, a library of peptide is generated, such as in form of phages, and this kind of libraries is contacted with the target molecule, in the present case, for example, the CD3 kappa peptides. Those peptides binding to the target molecule, i.e. one of the CD3 kappa peptides, are subsequently removed, preferably as a complex with the target molecule, from the respective reaction. It is known to the one skilled in the art that the binding characteristics, at least to a certain extend, depend on the particularly realized experimental set-up such as the salt concentration and the like. After separating those peptides binding to the target molecule with a higher affinity or a bigger force, from the non-binding members of the library, and optionally also after removal of the target molecule from the complex of target molecule and peptide, the respective peptide(s) may subsequently be characterised. Prior to the characterisation optionally an amplification step is realized such as, e.g. by propagating the peptide coding phages. The characterisation preferably comprises the sequencing of the target binding peptides. Basically, the peptides are not limited in their lengths, however, preferably peptides having a lengths from about 8 to 20 amino acids are preferably obtained in the respective methods. The size of the libraries may be about $10^2$ to $10^{18}$, preferably $10^8$ to $10^{15}$ different peptides, however, is not limited thereto. The thus identified peptides are also preferably referred to as peptide aptamers.

A particular form of target binding polypeptides are the so-called “anticalines” which are, among others, described in German patent application DE 197 42 706.

According to the present invention the protein of the CD3 kappa peptides and the nucleic acid(s) coding therefor may be used as the target for the manufacture or development of a medicament for the treatment of the diseases described herein and of the diseased conditions described herein, as well as for the manufacture and/or development of means for the diagnosis of said diseases and said conditions, in a screening process, whereby in the screening process small molecules or libraries of small molecules are used. This screening comprises the step of contacting the target molecule with a single small molecule or a variety of small molecules at the same time or subsequently, preferably those from the library as specified above, and identifying those small molecules or members of the library which bind to the target molecules which, if screened in connection with other small molecules may be separated from the non-binding or non-interacting small molecules. It will be acknowledged that the binding and non-binding may strongly be influenced by the particular experimental set-up. In modifying the stringency of the reaction parameters it is possible to vary the degree of binding and non-binding which allows a fine tuning of this screening process. Preferably, after the identification of one or several small molecules which specifically interact with the target molecule, this small molecule may be further characterised. This further characterisation may, for example, reside in the identification of the small molecule and determination of its molecule structure and further physical, chemical, biological and/or medical characteristics. Preferably, the natural compounds have a molecular weight of about 100 to 1000 Da. Also preferably, small molecules are those which comply with the Lepinsky rules of five known to the ones skilled in the art. Alternatively, small molecules may also be defined such that they are synthetic-small-molecules, preferably arising from combinatorial chemistry, in contrast to natural products which preferably are non-synthetic. However, it is to be noted that these definitions are only subsidiary to the general understanding of the respective terms in the art.

It is also within the present invention to use the CD3 kappa peptides and the nucleic acid(s) coding therefor as a target molecule for the manufacture or selection of aptamers and spiegelmers which may then be used directly or indirectly either as medicament or as diagnostic agents.

Aptamers are D-nucleic acids which are either single stranded or double stranded which specifically interact with a target molecule. The manufacture or selection of aptamers is, e.g., described in European patent EP 0 533 838. Basically the following steps are realized. First, a mixture of nucleic acids, i.e. potential aptamers, is provided whereby each nucleic acid typically comprises a segment of several, preferably at least eight subsequent randomised nucleotides. This mixture is subsequently contacted with the target molecule whereby the nucleic acid(s) bind to the target molecule, such as based on an increased affinity towards the target or with a bigger force thereto, compared to the candidate mixture. The binding nucleic acid(s) are/is subsequently separated from the remainder of the mixture. Optionally, the thus obtained nucleic acid(s) is amplified using, e.g. polymerase chain reaction. These steps may be repeated several times giving at the end a mixture having an increased ratio of nucleic acids specifically binding to the target from which the final binding nucleic acid is then optionally selected. These specifically binding nucleic acid(s) are referred to aptamers. It is obvious that at any stage of the method for the generation or identification of the aptamers samples of the mixture of individual nucleic acids may be taken to determine the sequence thereof using standard techniques. It is within the present invention that the aptamers may be stabilized such as, e.g., by introducing defined chemical groups which are known to the one skilled in the art of generating aptamers. Such modification may for example reside in the introduction of an amino group at the 2'-position of the sugar moiety of the nucleotides. Aptamers are currently used as therapeutic agents. However, it is also within the present invention that the thus selected or generated aptamers may be used for target validation and/or as lead substance for the development of medicaments, preferably of medicaments based on small molecules. This is actually done by a competition assay whereby the specific interaction between the target molecule and the aptamer is inhibited by a candidate drug whereby upon replacement of the aptamer from the complex of target and aptamer it may be assumed that the respective drug candidate allows a specific inhibition of the interaction between target and aptamer, and if the interaction is specific, said candidate drug will, at least in principle, be suitable to block the target and thus decrease its biological availability or activity in a respective system comprising such target. The thus obtained small molecule may then be subject to further derivatization and modification to optimise its physical, chemical, biological and/or medical characteristics such as toxicity, specificity, biodegradability and bioavailability.

The generation or manufacture of spiegelmers which may be used or generated according to the present invention using the CD3 kappa peptides or a nucleic acid coding therefor, is based on a similar principle. The manufacture of spiegelmers is described in the international patent application WO 98/08856. Spiegelmers are L-nucleic acids, which means that they are composed of L-nucleotides rather than aptamers which are composed of D-nucleotides as aptamers are. Spiegelmers are characterized by the fact that they have a very high stability in biological system and, comparable to aptamers, specifically interact with the target molecule against which they are directed which is for the purpose of this invention and if not indicated to the contrary, (a/the) CD3 kappa peptide(s) and the nucleic acids coding therefor. In the purpose of generating spiegelmers, a heterogonous population of D-nucleic acids is created and this population is contacted with the optical antipode of the target molecule, in the present case for example with the D-enantiomer of the naturally occurring L-enantiomer of the CD3 kappa peptides. Subsequently, those D-nucleic acids are separated which do not interact with the optical antipode of the target molecule. However, those D-nucleic acids interacting with the optical antipode of the target molecule are separated, optionally determined and/or sequenced and subsequently the corresponding L-nucleic acids are synthesized based on the nucleic acid sequence information obtained from the D-nucleic acids. These L-nucleic acids which are identical in terms of sequence with the aforementioned D-nucleic acids interacting with the optical antipode of the target molecule will specifically interact with the naturally occurring target molecule rather than with the optical antipode thereof. Similar to the method for the generation of aptamers it is also possible to repeat the various steps several times and thus to enrich those nucleic acids specifically interacting with the optical antipode of the target molecule.

The inventors want specially emphasize that the development of spiegelmers which bind to the CD3 kappa peptides is technically feasible because CD3 kappa peptides can be synthesized from L-amino acid compounds, whereby a synthesis of CD3 kappa peptides consisting of or containing D-amino acids is procurable. These CD3 kappa peptides consisting of or containing D-amino acids can be purified to 99,999% purity and produced in high amounts. A screening to generate spiegelmers with L-nucleic acids is therefore rapidly performed. The development and application of CD3 kappa binding spiegelmers to treat autoimmune diseases as those listed in table 2 is therefore safer to perform and is safer for patients as the application of a monoclonal antibody.

A further class of compounds which may be manufactured or generating based on the CD3 kappa peptides and in particular on the nucleic acids coding therefor, as the target molecule as disclosed herein, are ribozymes, antisense oligonucleotides and siRNA.

It is a common feature of all of the aforementioned nucleic acids that they do not interact with the target molecule at the level of the translation product which are in the present case the CD3 kappa peptides, but rather interact with the transcription product, i.e. the nucleic acid coding therefor such as the genomic nucleic acid or any nucleic acid derived there from such as the corresponding hnRNA, cDNA and mRNA, respectively. Insofar, the target molecule of the aforementioned class of compounds is preferably the mRNA of CD3 kappa. Most specifically these compounds are directed against the fusion region of CD3 kappa corresponding to the region encoded by exon 1, the part of exon 2 and exon 4 to prevent effects on the expression of CD3 delta.

Ribozymes are catalytically active nucleic acids which preferably consist of RNA which basically comprises two moieties. The first moiety shows a catalytic activity whereas the second moiety is responsible for the specific interaction with the target nucleic acid, in the present case the nucleic acids coding for the CD3 kappa peptides. Upon interaction between the target nucleic acid and the second moiety of the ribozyme, typically by hybridisation and Watson-Crick base pairing of essentially complementary stretches of bases on the two hybridising strands, the catalytically active moiety may become active which means that it catalyses, either intramolecularly or intermolecularly, the target nucleic acid in case the catalytic activity of the ribozyme is a phosphodiesterase activity. Subsequently, there may be a further degradation of the target nucleic acid which in the end results in the degradation of the target nucleic acid as well as the protein derived from the said target nucleic acid which in the present case are the CD3 kappa peptides due to a lack of newly synthesized CD3 kappa peptides and a turn-over of prior existing the CD3 kappa peptides. Ribozymes, their use and design principles are known to the one skilled in the art, and, for example described in Doherty and Doudna (Ribozym structures and mechanism. Annu ref. Biophys. Biomolstruct. 2001; 30:457-75) and Lewin and Hauswirth (Ribozyme Gene Therapy: Applications for molecular medicine. 2001 7:221-8).

The use of antisense oligonucleotides for the manufacture of a medicament and as a diagnostic agent, respectively, is based on a similar mode of action. Basically, antisense oligonucleotides hybridise based on base complementarity, with a target RNA, preferably with a mRNA, thereby activate RNase H. RNase H is activated by both phosphodiester and phosphorothioate-coupled DNA. Phosphodiester-coupled DNA, however, is rapidly degraded by cellular nucleases with the exception of phosphorothioate-coupled DNA. These resistant, non-naturally occurring DNA derivatives do not inhibit RNase H upon hybridisation with RNA. In other words, antisense polynucleotides are only effective as DNA:RNA hybride complexes. Examples for this kind of antisense oligonucleotides are described, among others, in U.S.-patent U.S. Pat. No. 5,849,902 and U.S. Pat. No. 5,989,912. In other words, based on the nucleic acid sequence of the target molecule which in the present case are the nucleic acids coding for the CD3 kappa peptides, either from the target protein from which a respective nucleic acid sequence may in principle be deduced, or by knowing the nucleic acid sequence as such, particularly the mRNA, suitable antisense oligonucleotides may be designed base on the principle of base complementarity.

Particularly preferred are antisense-oligonucleotides which have a short stretch of phosphorothioate DNA (3 to 9 bases). A minimum of 3 DNA bases is required for activation of bacterial RNase H and a minimum of 5 bases is required for mammalian RNase H activation. In these chimeric oligonucleotides there is a central region that forms a substrate for RNase H that is flanked by hybridising "arms" comprised of modified nucleotides that do not form substrates for RNase H. The hybridising arms of the chimeric oligonucleotides may be modified such as by 2'-O-methyl or 2'-fluoro. Alternative approaches use methylphosphonate or phosphoramidate linkages in said arms. Further embodiments of the antisense oligonucleotide useful in the practice of the present invention are P-methoxyoligonucleotides, partial P-methoxyoligodeoxyribonucleotides or P-methoxyoligonucleotides.

Of particular relevance and usefulness for the present invention are those antisense oligonucleotides as more particularly described in the above two mentioned U.S. patents. These oligonucleotides contain no naturally occurring 5'→3'-linked nucleotides. Rather the oligonucleotides have two types of nucleotides: 2'-deoxyphosphorothioate, which activate RNase H, and 2'-modified nucleotides, which do not. The linkages between the 2'-modified nucleotides can be phosphodiesters, phosphorothioate or P-ethoxyphosphodiester. Activation of RNase H is accomplished by a contiguous RNase H-activating region, which contains between 3 and 5 2'-deoxyphosphorothioate nucleotides to activate bacterial RNase H and between 5 and 10 2'-deoxyphosphorothioate nucleotides to activate eukaryotic and, particularly, mammalian RNase H. Protection from degradation is accomplished by making the 5' and 3' terminal bases highly nuclease resistant and, optionally, by placing a 3' terminal blocking group.

More particularly, the antisense oligonucleotide comprises a 5' terminus and a 3' terminus; and from 11 to 59 5'→3'-linked nucleotides independently selected from the group consisting of 2'-modified phosphodiester nucleotides and 2'-modified P-alkyloxyphosphotriester nucleotides; and wherein the 5'-terminal nucleoside is attached to an RNase H-activating region of between three and ten contiguous phosphorothioate-linked deoxyribonucleotides, and wherein the 3'-terminus of said oligonucleotide is selected from the group consisting of an inverted deoxyribonucleotide, a contiguous stretch of one to three phosphorothioate 2'-modified ribonucleotides, a biotin group and a P-alkyloxyphosphotriester nucleotide.

Also an antisense oligonucleotide may be used wherein not the 5' terminal nucleoside is attached to an RNase H-activating region but the 3' terminal nucleoside as specified above. Also, the 5' terminus is selected from the particular group rather than the 3' terminus of said oligonucleotide.

Suitable and useful antisense oligonucleotides are also those comprising a 5' terminal RNase H activating region and having between 5 and 10 contiguous deoxyphosphorothioate nucleotides; between 11 to 59 contiguous 5'→3'-linked 2'-methoxyribonucleotides; and an exonuclease blocking group present at the 3' end of the oligonucleotide that is drawn from the group consisting of a non-5'-3'-phosphodiester-linked nucleotide, from one to three contiguous 5'-3'-linked modified nucleotides and a non-nucleotide chemical blocking group.

Two classes of particularly preferred antisense oligonucleotides can be characterized as follows:

The first class of antisense oligonucleotides, also referred to herein as second generation of antisense oligonucleotides, comprises a total of 23 nucleotides comprising in 5'→3' direction a stretch of seven 2'-O-methylribonucleotides, a stretch of nine 2'-deoxyribonucleotides, a stretch of six 2'-O-methylribonucleotides and a 3'-terminal 2'-deoxyribonucleotide. From the first group of seven 2'-O-methylribonucleotides the first four are phosphorothioate linked, whereas the subsequent four 2'-O-methylribonucleotides are phosphodiester linked. Also, there is a phosphodiester linkage between the last, i.e. the most 3'-terminal end of the 2'-O-methylribonucleotides and the first nucleotide of the stretch consisting of nine 2'-deoxyribonucleotides. All of the 2'-deoxyribonucleotides are phosphorothioate linked. A phosphorothioate linkage is also present between the last, i.e. the most 3'-terminal 2'-deoxynucleotide, and the first 2'-O-methylribonucleotide of the subsequent stretch consisting of six 2'-O-methylribonucleotides. From this group of six 2'-O-methylribonucleotides the first four of them, again in 5'→3' direction, are phosphodiester linked, whereas the last three of them, corresponding to positions 20 to 22 are phosphorothioate linked. The last, i.e. terminal 3'-terminal 2'-deoxynucleotide is linked to the last, i.e. most 3'-terminal 2'-O-methylribonucleotide through a phosphorothioate linkage.

This first class may also be described by reference to the following schematic structure: RRRnnnnNNNNNNNNNnnnRRRN. Hereby, R indicates phosphorothioate linked 2'-O-methyl ribonucleotides (A, G, U, C); n stands for 2'-O-methyl ribonucleotides (A, G, U, C); N represents phosphorothioate linked deoxyribonucleotides (A, G, T, C).

The second class of particularly preferred antisense oligonucleotides, also referred to herein as third generation (of) antisense oligonucleotides or GeneBlocs, also comprises a total of 17 to 23 nucleotides with the following basic structure (in 5'→3' direction).

At the 5'-terminal end there is an inverted abasic nucleotide which is a structure suitable to confer resistance against exonuclease activity and, e.g., described in WO 99/54459. This inverted abasic nucleotide is linked to a stretch of five to seven 2'-O-methylribonucleotides which are phosphodiester linked. Following this stretch of five to seven 2'-O-methylribonucleotides there is a stretch of seven to nine 2'-deoxyribonucleotides all of which are phosphorothioate linked. The linkage between the last, i.e. the most 3'-terminal 2'-O-methylribonucleotide and the first 2'-deoxynucleotide of the 2'-deoxynucleotide comprising stretch occurs via a phosphodiester linkage. Adjacent to the stretch of seven to nine 2'-deoxynucleotides a stretch consistent of five to seven 2'-O-methylribonucleotides is connected. The last 2'-deoxynucleotide is linked to the first 2'-O-methylribonucleotide of the latter mentioned stretch consisting of five to seven 2'-O-methylribonucleotides occurs via a phosphorothioate linkage. The stretch of five to seven 2'-O-methylribonucleotides are phosphodiester linked. At the 3'-terminal end of the second stretch of five to seven 2'-O-methylribonucleotide another inverted abasic nucleotide is attached.

This second class may also be described by reference to the following schematic structure: (GeneBlocs representing the 3rd generation of antisense oligonucleotides have also the following schematic structure:) cap-$(n_p)_x(N_s)_y(n_p)_z$-cap or cap-nnnnnnnNNNNNNNNNnnnnnnn-cap. Hereby, cap represents inverted deoxy abasics or similar modifications at both ends; n stands for 2'-O-methyl ribonucleotides (A, G, U, C); N represents phosphorothioate-linked deoxyribonucleoties (A, G, T, C); x represents an integer from 5 to 7; y represents an integer from 7 to 9; and z represents an integer from 5 to 7.

It is to be noted that the integers x, y and z may be chosen independently from each other although it is preferred that x and z are the same in a given antisense oligonucleotide. Accordingly, the following basic designs or structures of the antisense oligonucleotides of the third generation can be as follows: cap-$(n_p)_5(N_s)_7(n_p)_5$-cap, cap-$(n_p)_6(N_s)_7(n_p)_5$-cap, cap-$(n_p)_7(N_s)_7(n_p)_5$-cap, cap-$(n_p)_5(N_s)_8(n_p)_5$-cap, cap-$(n_p)_6(N_s)_8(n_p)_5$-cap, cap-$(n_p)_7(N_s)_8(n_p)_5$-cap, cap-$(n_p)_5(N_s)_9(n_p)_5$-cap, cap-$(n_p)_6(N_s)_9(n_p)_5$-cap, cap-$(n_p)_7(N_s)_9(n_p)_5$-cap, cap-$(n_p)_5(N_s)_7(n_p)_6$-cap, cap-$(n_p)_6(N_s)_7(n_p)_6$-cap, cap-$(n_p)_7(N_s)_7(n_p)_6$-cap, cap-$(n_p)_5(N_s)_8(n_p)_6$-cap, cap-$(n_p)_6(N_s)_8(n_p)_6$-cap, cap-$(n_p)_7(N_s)_8(n_p)_6$-cap, cap-$(n_p)_5(N_s)_9(n_p)_6$-cap, cap-$(n_p)_6(N_s)_9(n_p)_6$-cap, cap-$(n_p)_7(N_s)_9(n_p)_6$-cap, cap-$(n_p)_5(N_s)_7(n_p)_7$-cap, cap-$(n_p)_6(N_s)_7(n_p)_7$-cap, cap-$(n_p)_7(N_s)_7(n_p)_7$cap, cap-$(n_p)_5(N_s)_8(n_p)_7$-cap, cap-$(n_p)_6(N_s)_8(n_p)_7$-cap, cap-$(n_p)_7(N_s)_8(n_p)_7$-cap, cap-$(n_p)_5(N_s)_9(n_p)_7$-cap, cap-$(n_p)_6(N_s)_9(n_p)_7$-cap and cap-$(n_p)_7(N_s)_9(n_p)_7$-cap.

A further class of compounds which may be generated based on the technical teaching given herein and which may be used as medicaments and/or diagnostic agents are small interfering RNA (siRNA) directed to the nucleic acids, preferably mRNA, coding for the CD3 kappa peptides. siRNA is a double stranded RNA having typically a length of about 21 to about 23 nucleotides. The sequence of one of the two RNA strands corresponds to the sequence of the target nucleic acid such as the nucleic acid coding for the CD3 kappa peptides, to be degraded. Most specifically the siRNA is directed against the fusion region of CD3 kappa corresponding to the region encoded by exon 1, the part of exon 2 and exon 4 to prevent effects on the expression of CD3 delta. This kind of consideration is, in principle, applicable to all of the various classes of compounds of CD3 kappa related compounds as disclosed herein and thus defines a preferred specificity thereof. In other words, knowing the nucleic acid sequences of the target molecule, in the present case the CD3 kappa peptides, preferably the mRNA sequence, a double stranded RNA may be designed with one of the two strands being complementary to said, e.g. mRNA of the CD3 kappa peptides and, upon application of said siRNA to a system containing the gene, genomic DNA, hnRNA or mRNA coding for the CD3 kappa peptides, the respective target nucleic acid will be degraded and thus the level of the respective protein be reduced. The basic principles of designing, constructing and using said siRNA as medicament and diagnostic agent, respectively, is, among others, described in international patent applications WO 00/44895 and WO 01/75164.

Based on the aforementioned design principles, it is possible to generate such siRNA, antisense oligonucleotide and ribozyme, respectively, once the nucleic acid sequences coding for the CD3 kappa peptides are known. This is also true for precursor molecules of nucleic acid such as hnRNA, cDNA and the like, including genomic nucleic acid. Of course, also knowing the respective antisense strand may allow the design of such nucleic acid based compounds given the basic principle of base pair complementarity, preferably based on Watson-Crick base pairing. Accordingly, a further aspect of the present invention is related to specific siRNAs, ribozymes and antisense nucleotides which are directed against or specific for the CD3 kappa peptides. In the following, this is further illustrated by siRNA, however, this applies to antisense oligonucleotides and ribozymes as well, as will be acknowledged by the ones skilled in the art.

Such siRNA comprises preferably a length of from 15 to 25 nucleotides, whereby this means actually any length comprising 15, 16, 17, 18, 19, 20, 21, 22, 23, 24 or 25 nucleotides. In further embodiments, the siRNA may even exhibit more nucleotides. According the design principles well known in the art, respective siRNA can be generated. Accordingly, the siRNA claimed herein comprises a stretch of preferably any nucleotide length from 15 to 25 consecutive nucleotides which is either at least partially complementary to the sense or to the antisense strand encoding the CD3 kappa peptides, and a second ribonucleotide strand which is at least partially complementary to the first one and thus to the antisense strand and sense strand respectively, encoding the CD3 kappa peptides. Any design principle known in the art of generation or manufacture of siRNA may be applied to this kind of duplex structure. The siRNA space disclosed herein comprises siRNA molecules whereby the antisense strand of which starts with a nucleotide which corresponds to nucleotide no. 1 of a sequence coding for the CD3 kappa peptides as specified above. Further such siRNA molecules start with a nucleotide which corresponds to the nucleotide no 2 of a sequence coding for the CD3 kappa peptides as specified above, and so on. This kind of scanning over the sequence coding for the CD3 kappa peptides is repeated so as to provide all possible siRNA molecules which can be directed against the CD3 kappa peptides. The length of any of the siRNA molecules thus generated may be any length suitable for siRNA, more particularly any length as specified above. Preferably, the various siRNA molecule of the siRNA molecule space disclosed herein, overlap except the most 5' terminal nucleotide of the antisense strand or sense strand. It is obvious that the thus obtained antisense sequences have to complement through base pairing so as to form the at least partially double-stranded structure required for a functionally active siRNA Based on the mode of action of the aforementioned classes of compounds, such as antibodies, peptides, anticalines, aptamers, spiegelmers, ribozymes, antisense oligonucleotides as well as siRNA, it is thus also within the present invention to use any of these compounds targeting the CD3 kappa peptides and the nucleic acid coding therefor, respectively, for the manufacture of a medicament or a diagnostic agent for any of the diseases as described herein and any of the diseased conditions described herein. Furthermore, these agents may be used to monitor the progression of said diseases and diseased conditions and the success of any therapy applied, respectively.

The various classes of compounds designed according to the present invention such as antibodies, peptides, anticalines, small molecules, aptamers, spiegelmers, ribozymes, antisense oligonucleotides and siRNA may also be contained in a pharmaceutical composition. Preferably such pharmaceutical composition is used for the treatment of the diseases as described herein or the diseased conditions described herein. The pharmaceutical composition may comprise in an embodiment one or several of the aforementioned classes of compounds and/or one or more members of a single class, and optionally a further pharmaceutical active compound, and a pharmaceutically acceptable carrier. Such carrier may be either liquid or solid, for example a solution, a buffer, an alcoholic solution or the like. Suitable solid carriers are, among others, starch and the like. It is known to the one skilled in the art to provide respective formulations for the various compounds according to the aforementioned classes of compounds in order to realize the particular route of administrations such as oral, parenteral, subcutaneous, intravenous, intramuscular and the like.

The various compounds of the different classes of compounds as mentioned above, may also be, either alone or in combination, subject to or contained in a kit. Such kit comprises apart from the respective compound(s) additionally one or several further elements or compounds whereby the elements are selected from the group comprising buffers, negative controls, positive controls and instructions on the use of the various compounds. Preferably, the various compounds are present in either dry or liquid form, preferably as a unit dosage for a single administration each. The kit may particularly be used for the therapy, diagnosis or monitoring of the progress of the disease or applied therapies in relation to the diseases and diseased conditions as described herein.

EXAMPLE 1

Materials and Methods

Peptide Synthesis

The purity and identity of the peptides (WITA, Teltow, Germany) was checked by reverse-phase HPLC and matrix-assisted laser desorption ionization mass spectroscopy. The 42 amino acid long CD3kappa (SQVSPFKIPIEELEDRVFVNCNTSIYRASSLSN CRHTSSVEE) (SEQ ID NO:4) had a purity of >99,9999%, while the control peptide (SESVNISTNVNRFHTFPYCEIAEVSCRSKVRIELDLQSPESS) (SEQ ID NO:4438) with the same amino acid composition but a random sequence had a purity of >98%.

Origin of Human Materials

All materials were taken from patients after informed consent. Peripheral blood mononuclear cells (PBMCs) were obtained from normal individuals (laboratory personnel). Splenocytes were isolated from spleens removed from cadaveric organ donors provided for HLA-typing and crossmatch studies in the context of liver transplantation.

Joint effusion fluids from rheumatoid arthritis patients were obtained in the context of therapeutic joint puncture.

Preparation of PBMCs

Heparinized full blood was layered on room-temperature LSM (density: 1.077 g/ml, Cambrex, Verviers, Belgium). After centrifugation at 400 g at 20° C. for 30 minutes, the interphase cells were isolated. The cells were washed twice with 50 ml PBS containing 2 mM EDTA and centrifuged at 300 g for 10 minutes at 20° C. The cell-pellet was resuspended in RPMI supplemented with 10% autologous serum, Pen/Strep, Gentamycin, Pyruvate, Hepes-buffer and L-Glutamine (Cambrex).

T Cell Cultures

PBMCs were used from Donor 1 (DRB1*0401, 1501), Donor 2 (DRB1*1501, DRB1*1601, DQB1*0502, DQB1*0602) and Donor 3 (DRB1*0701, DRB1*1501, DQB1*0303, DQB1*0602). PBMCs were incubated with 10 μM peptide and 100 U/ml IL-2 at $5\times10^6$ cells/ml for 30-40 days. 20 U/ml IL-2 was added every 4 days. The cultures were restimulated four times before analysis with the same conditions.

Generation of Dendritic Cells and T-Cell Stimulation

The in vitro priming with Dendritic cells (DC) was performed with peptide labeled DCs generated from peripheral blood monocytes. The adherent monocytes were treated with 1000 U/ml GM-CSF (BD) and 1000 U/ml IL-4 (BD) for 8 days. Non-adherent mature DCs were activated by addition of 1000 U/ml TNFα (BD), 50 ng/ml IL-1 (BD) and 1 μM Prostaglandin E2 (Calbiochem, Schwalbach, Germany). The peptide labeled DCs (labeled with 100 μM peptide for 2 h) were mixed in a ratio of 1:50 with fresh isolated PBMCs and 100 U/ml IL-2, 50 ng/ml IL-7 (BD) and 50 ng/ml IL-15 (BD) were added. The further culture and restimulation was performed as describe above.

CD3 Delta RT-PCR

All reagents were from Qiagen (Hilden, Germany) if not otherwise stated. $10^7$ cells were stimulated and centrifuged as in the Cytokine capture assay. The pellet was resuspended in 600 μl Buffer RLT. Samples were homogenized with QIAshredder columns and 1 volume of 70% ethanol was added. RNA was bound to RNeasy mini spin column by centrifugation for 15 sec at 8000 g, followed by one wash step with 700 μl Buffer RW1 and two wash steps with 500 μA Buffer RPE. RNA was eluted in 650 μl water, mixed with 650 μl buffer OBB and 30 μl Oligotex suspension. The samples were incubated for 3 minute at 70° C. and placed at room temperature for 10 minutes. The Oligotex:mRNA complex was pelleted by centrifugation for 2 min at 18000 g and resuspended in 600 μl Buffer OW2. The suspension was pipetted onto a spin column and washed with 600 μl Buffer OW2. mRNA was eluted with 20 μl 70° C. Buffer OEB. cDNA-synthesis was performed for 2 h at 50° C. with the following reaction mix: 2 μl 10×RT Buffer, 2 μl dNTP Mix (5 mM of each dNTP), 0.4 μl Oligo-dT primer (50 μM, Perkin Elmer), 0.5 μl Sensicript, 0.5 μl Omniscript and 14.6 μl mRNA. PCR included 12.5 μl HotStarTaq Mastermix, 0.25 μl huCD3d-5 (50 μM, TTCAAGATACCTATAGAGGAACTTGAGGAC) (SEQ ID NO:4439), 0.25 μl huCD3d-3 (50 μM, TAGACCTGGTCATTCCTCAACAGAGCTTG) (SEQ ID NO:4440) and 12 μl cDNA. The PCR conditions were 40 cycles of 45 sec at 96° C., 45 sec at 64° C. and 60 sec at 72° C. The PCR product was separated on a 1% agarose gel and the 220 bp band excised. The DNA was isolated with QIAEX and ligated in the PCR 2.1 vector (Invitrogene, Karlsruhe, Germany). TOP10 *E. coli* (Invitrogene) were transformed with the ligation product and plated with 100 μg/ml ampicillin. Plasmid minipreps of four individual clones were sequenced each two times with the PCR primers. 100% identical sequences were obtained from all eight sequencing results.

Functional CD3 Kappa Assays

CD3 kappa or the control peptide was solubilized in RPMI with 1% human serum albumin (HSA, Calbiochem, Schwalbach, Germany) and 100 μM β-mercaptoethanol (β-ME, Invitrogene) at 10 mg/ml. PBMCs were incubated at $10^6$ cells/ml with either peptide in the same medium and stained after on wash step with PBS with various antibodies (BD).

Protein Microarrays

All reagents were from Raybiotech (Hilden, Germany). 2 ml supernatant from cultures with $5\times10^6$ cells/ml was mixed with blocking buffer (BB) and pipetted to blocked human cytokine micro arrays 6.1 and 7.1. After overnight incubation, the membranes were washed three times with wash buffer I and two times with wash buffer II. Anti-cytokine antibodies were added in 2 ml BB. After incubation and wash as described above, 2 ml streptavidin-HRP was added. Again after incubation and wash as described above, detection solution was added and exposure for 18 h to X-ray films were performed.

EXAMPLE 2

Identification of CD3 Kappa

CD 3 kappa was found in T-cell cultures upon stimulation with heteroclitic peptides resulting in an increased expression of IFN-gamma, CD4 and TCR. CD3 kappa is a splice variant of CD3 delta and was not present in T-cells which were challenged with the same heteroclitic peptide but did not increase IFN gamma production. Also, normal human splenocytes used as control showed the expected full length CD3-delta-cDNA, but not CD3 kappa and the corresponding 220 bp fragment as may be taken from FIG. 1A.

The inventors also found CD3 kappa expression in peripheral blood mononuclear cells (PBMCs) from healthy donors and from patients with different autoimmune diseases. Surprisingly two of three samples from knee effusions of patients with rheumatoid arthritis showed only the expression of this 220 bp band and no full length CD3delta expression as may be taken from FIG. 1B. In vitro primed T cells, stimulated with dendritic cells, IL-2, IL-7, IL-15 and loaded with cross-reactive peptides derived from a human tumor-associated antigen expressed this 220 bp band, while it was lacking in the same cultures in the absence of in vitro priming (see FIG. 1A and FIG. 1C). The 220 bp variant was sequenced and identified as a novel splice variant of CD3-delta, which is missing exon 3 and a part of exon 2 but contains the complete exons 1, 4 and 5 as depicted in FIG. 1D. This alternative splicing results in a frame shift in exon 2 and yields an open reading frame of 174 bp. The resulting polypeptide has still the first 41 N-terminal amino acids of CD3delta, including the signal peptide. However the C-terminus has a completely different sequence, whereby a transmembrane region is missing which is deemed the reason that the polypeptide is secreted. The putative CD3kappa peptide as produced by the ribosome should thus contain 58 amino acids, including the 17 new amino acids encoded by the overlap region of exon 2 and exon 3 (SEQ ID NO:1). However, the hydrophobic signal peptide is removed during transfer in the endoplasmic reticulum and therefore the secreted CD3kappa should not contain the first 16 amino acids. We synthesized the resulting 42 amino acids polypeptide without the signal peptide.

EXAMPLE 3

Effect of CD3 Kappa on TCR Expression

Figure 2A:
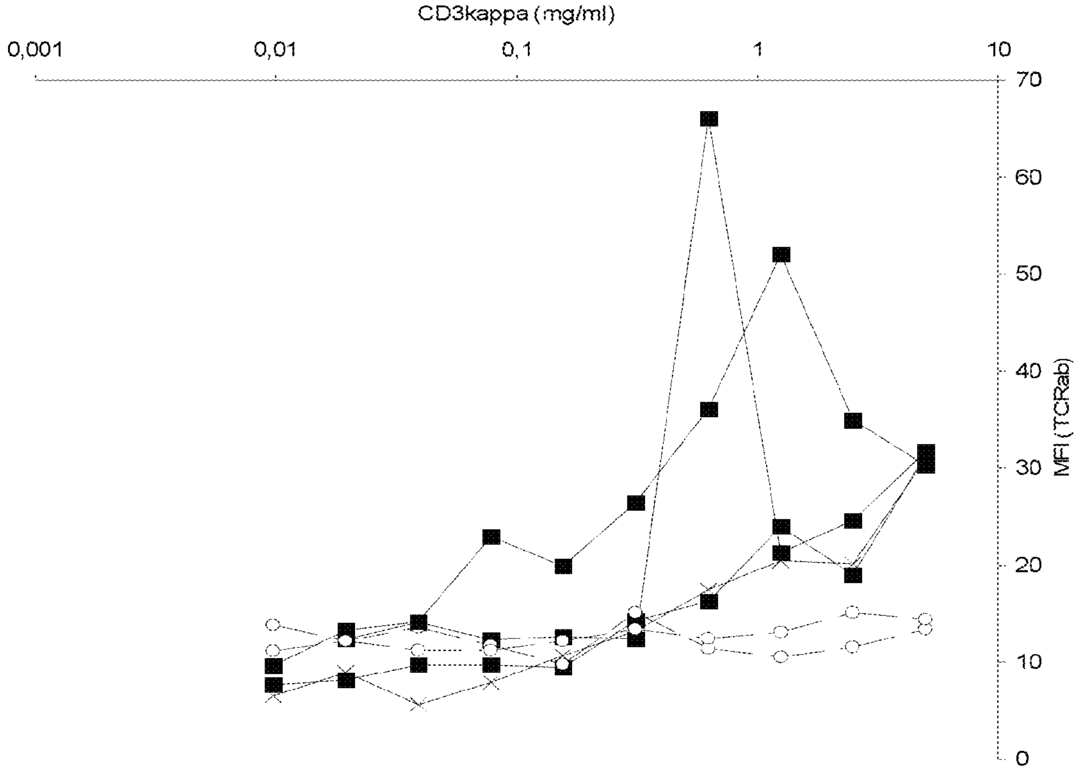
FIG. 2*a* is a histogram indicating the surface expression strength of CD4+ PBMCs expressing TCR upon treatment with CD3 kappa (■) or with a control peptide (o: same amino-acid composition, but random sequence); whereby also one sample of CD4+ PBMCs expressing TCR upon treatment with CD3 kappa together with PMA and ionomycin is also shown (x)

We synthesized the resulting 42 amino acids polypeptide without the signal sequence resulting in the CD3 kappa peptide having the amino acid sequence according to SEQ ID NO:4. All following experiments were performed with freshly isolated PBMCs from healthy donors in the presence of the 42-mer CD3-kappa or of a control peptide (consisting of the same amino acid composition and length but with a random sequence). The CD4+ cells from three healthy donors showed a concentration dependent increase in TCR-expression after 24 h as may be taken from FIG. 2A, with a detectable TCR-upregulation after treatment with 0.1 mg/ml CD3-kappa or more. Stimulation of the cells with PMA and ionomycin did not affect this finding. The control peptide had no effect on TCR expression. Concentrations up to 1 mg/ml CD3-kappa induced a maximal response after 24 h resulting in a six fold upregulation of the TCR.

Figure 2B:
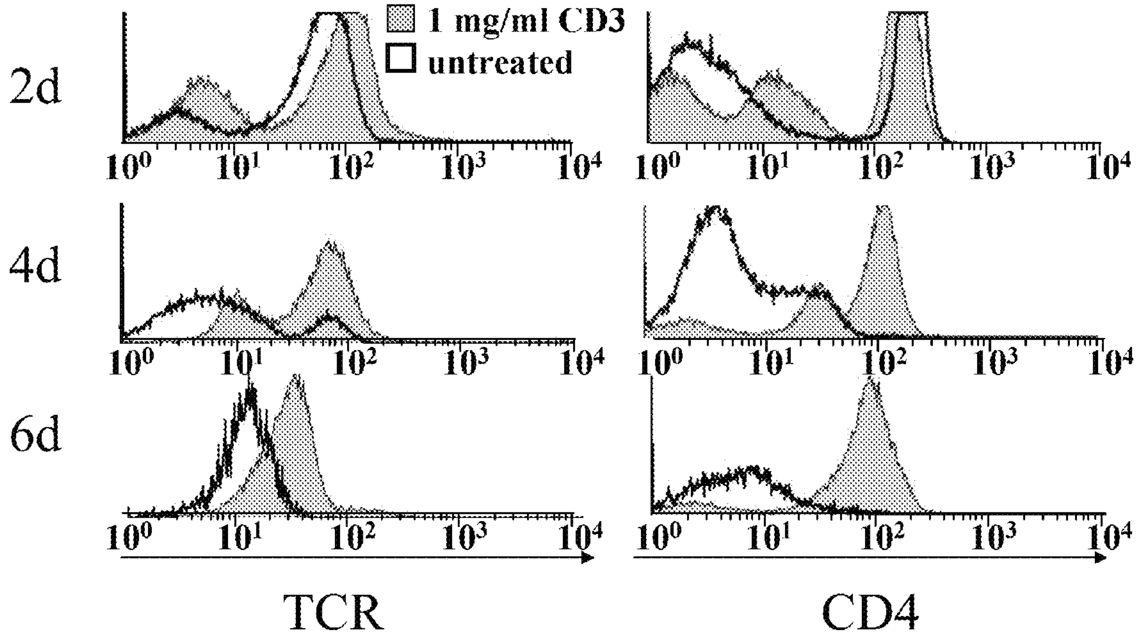
FIG. 2*b* shows histograms indicating the surface expression strength of CD4+ PBMCs expressing TCR and CD4 upon treatment with CD3 kappa, whereby a kinetic ranging from two to six days is shown.

Addition of CD3-kappa to PBMCs lead to a remarkable and sustained increase of TCR and CD4 expression over the next 6 days as may be taken from FIG. 2B. The TCR-expression level was stabilized after treatment with CD3-kappa in a majority of the CD4 cells, while untreated cells quickly converted to a low TCR expression state. Only at day 6 did the CD3-kappa treated cells show a decline in TCR expression. The CD4-expression was nearly completely stable over 6d after treatment with CD3-kappa while it was dramatically down regulated after 48 h in the control cultures.

EXAMPLE 4

Impact of CD3 Kappa on Cellsurface Markers

Figure 3A:
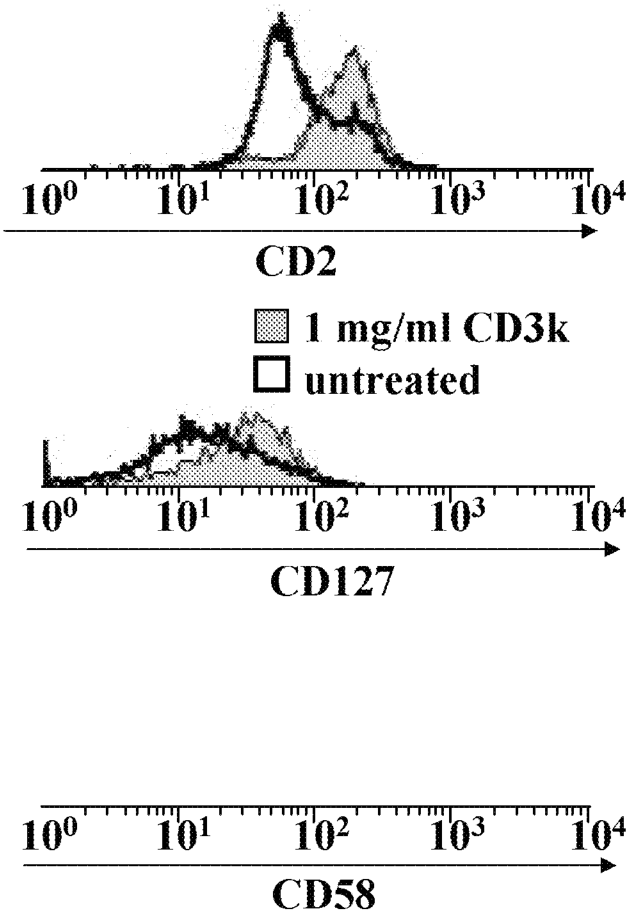
FIG. 3*a* is a histogram indicating the surface expression strength of PBMCs expressing surface markers CD2, CD127 and CD58 upon treatment and non-treatment with CD3 kappa after six days.
Figure 4A:
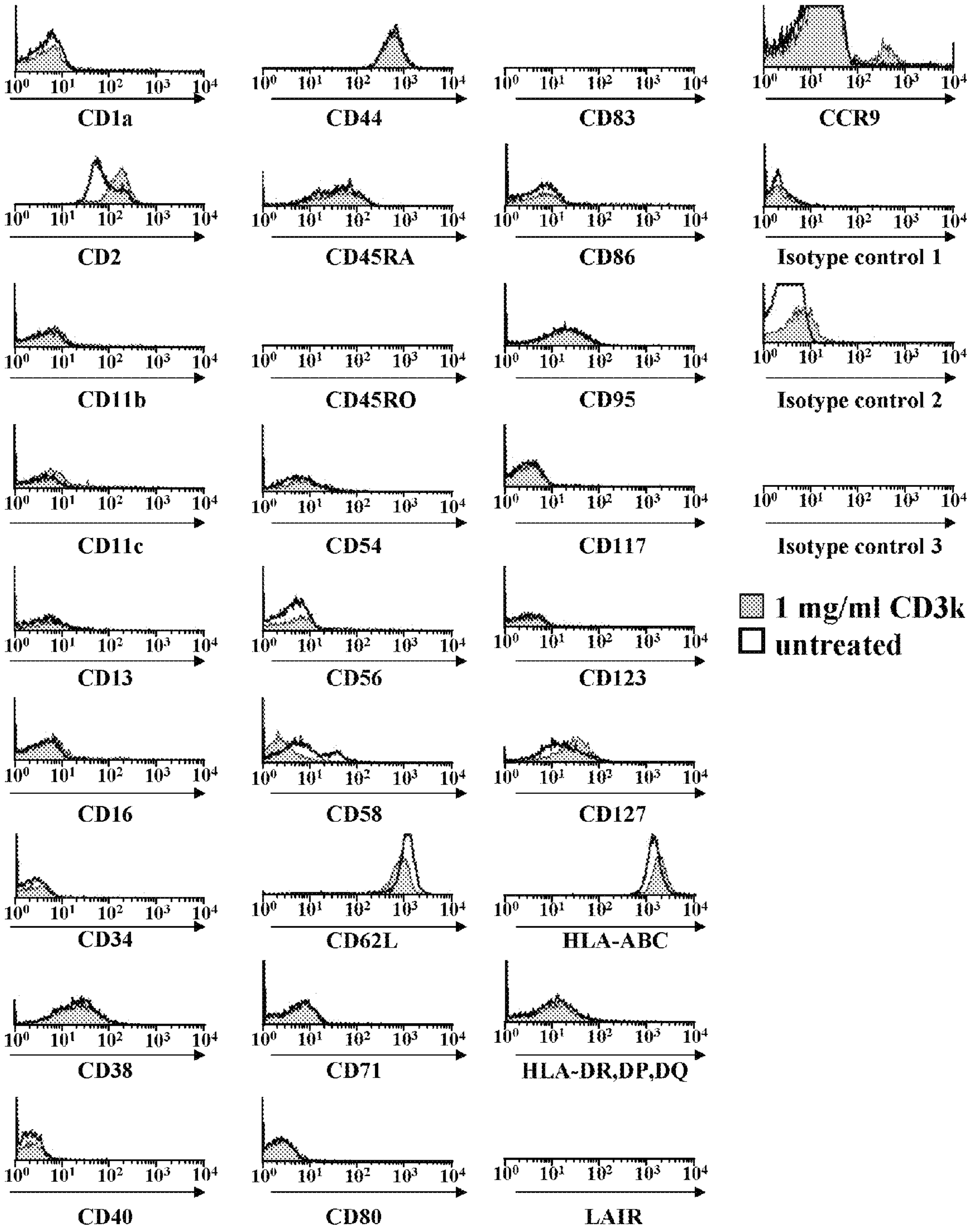
FIG. 4*a* depicts histograms indicating the surface expression strength of PBMCs expressing various surface markers upon treatment and non-treatment with CD3 kappa after six days.
Figure 4B:
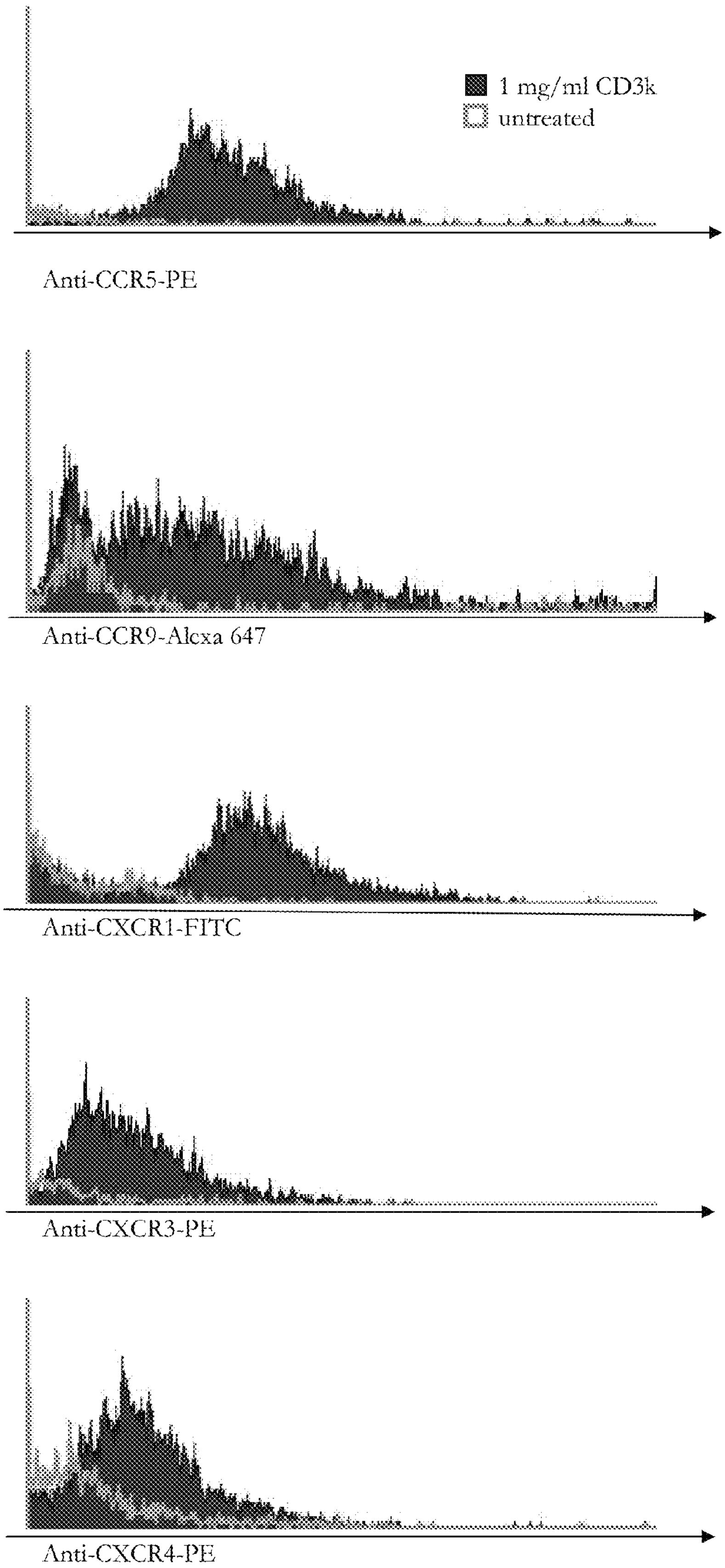
FIG. 4*b* depicts histograms indicating the surface expression strength of PBMCs expressing cytokine- or chemokine-receptors upon treatment and non-treatment with CD3 kappa after six days.
Figure 4B:
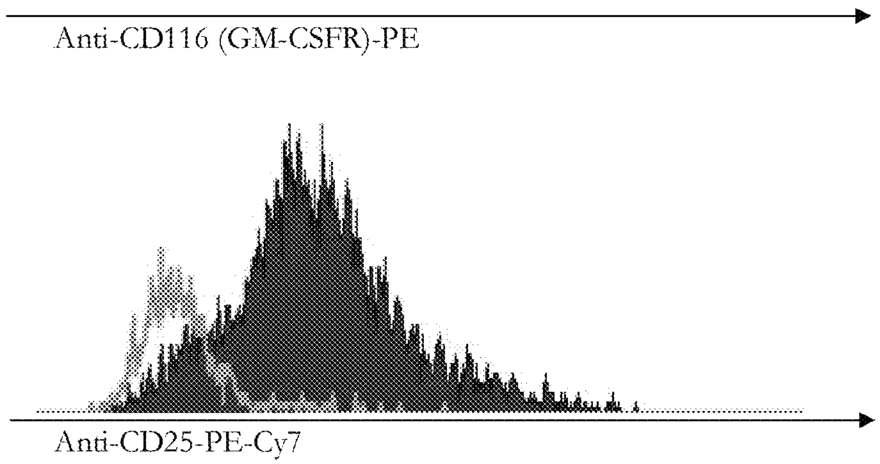

Analysis of the cell surface markers after addition of CD3-kappa showed an increase in the expression of CD2, CD25, CD116, CD127, CCR3, CCR9 and CXCR1. CD3kappa also leads to an a slight upregulation of CXCR3 and CXCR4 as may be taken from FIGS. 3*a*, 4*a* and 4*b*.

Figure 3B:
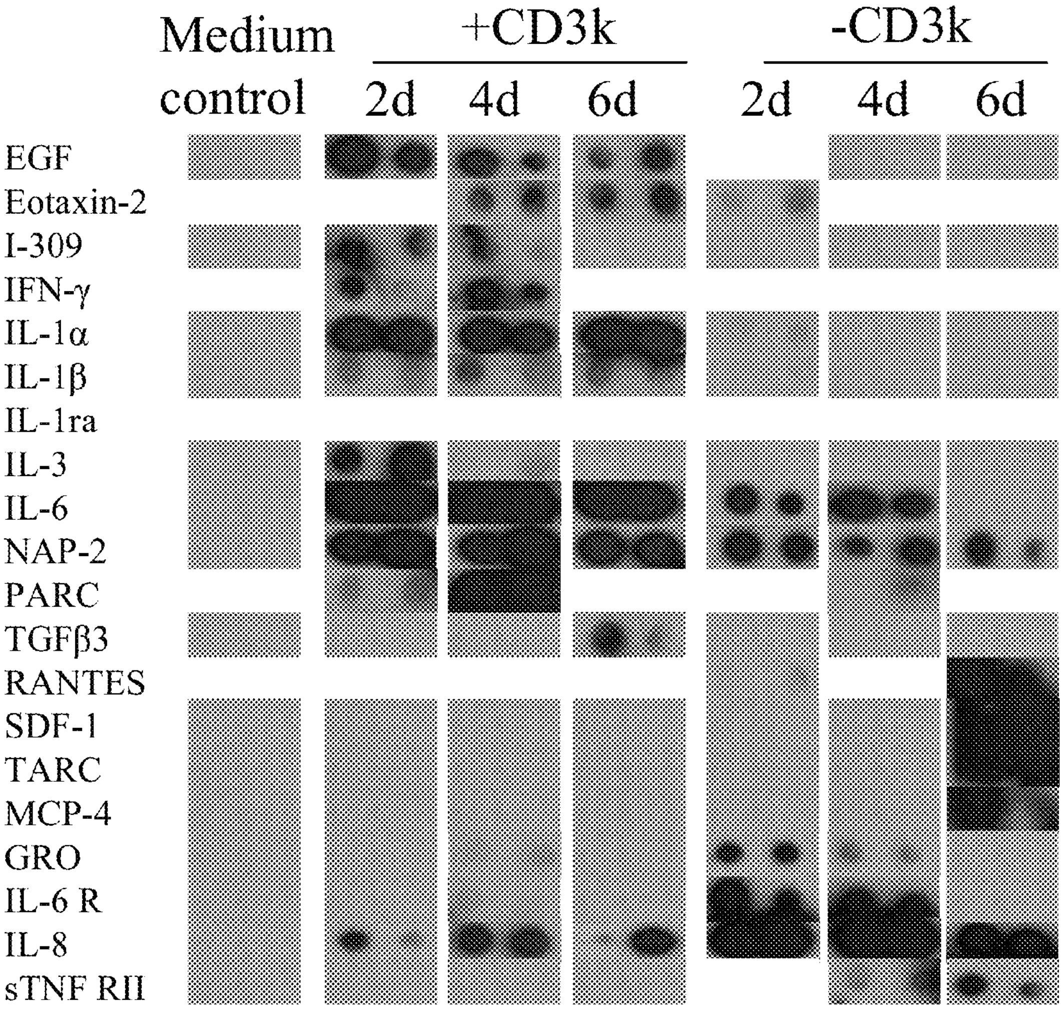
FIG. 3*b* is a Western Blot of a dot blot microarray analysis of T cell secreted factors after various time points, whereby only significant changes cytokine expressions and double dot blots are shown.
Figure 3C:
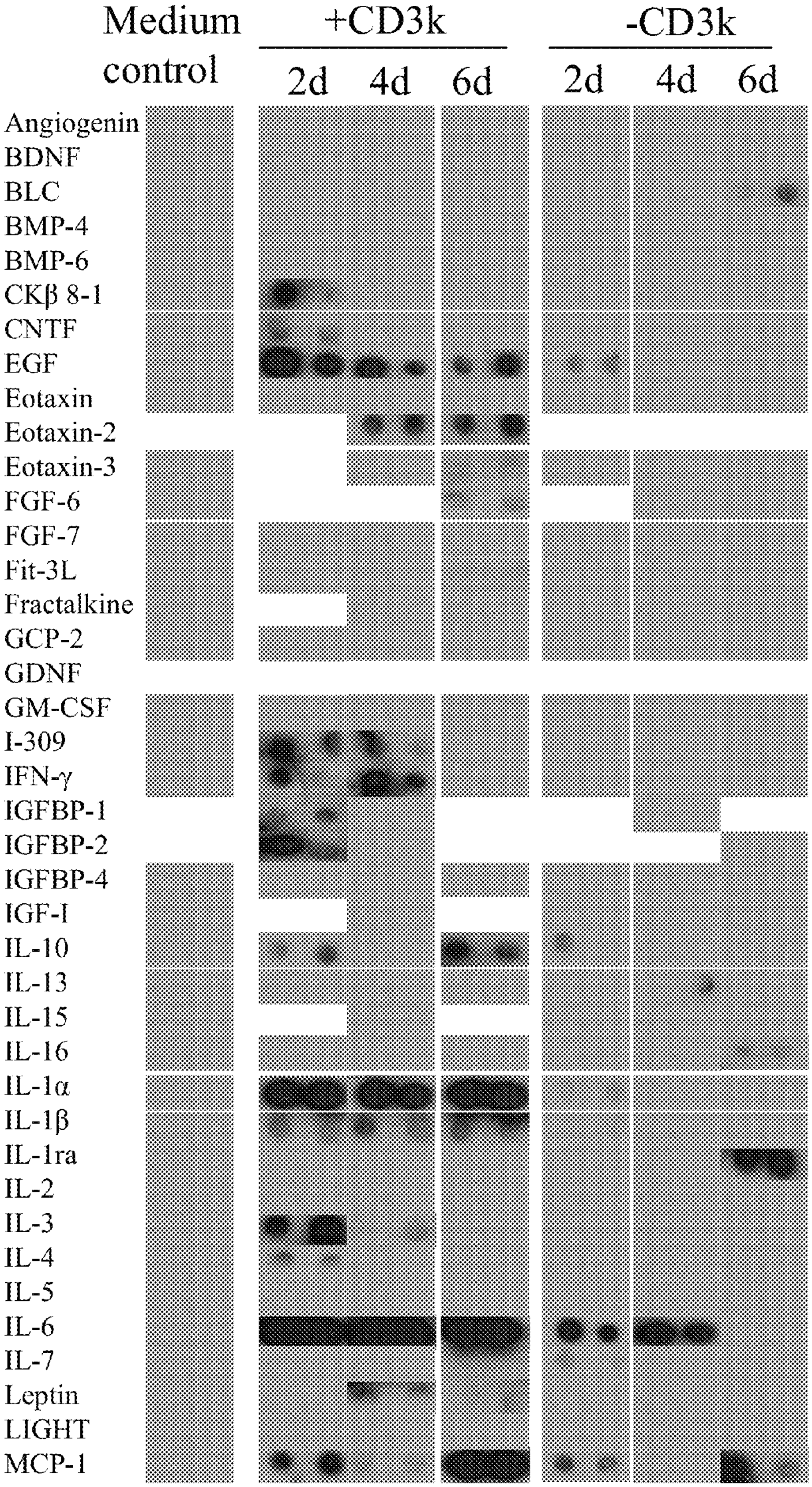
FIG. 3*c* is a Western Blot of a dot blot microarray analysis of T cell secreted factors after various time points, whereby all analyzed cytokine expression patterns and double dot blots are shown.
Figure 3C:
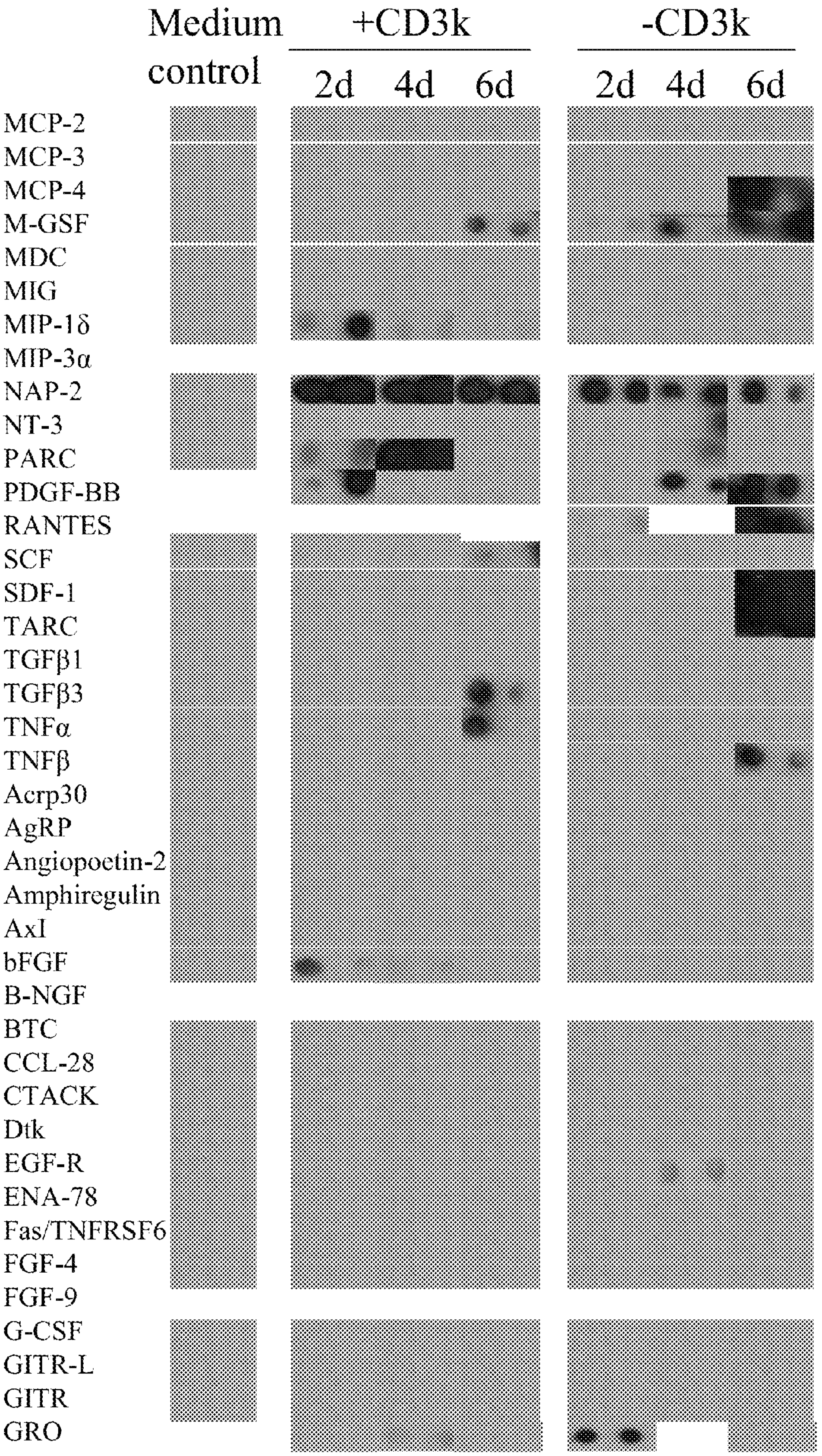
Figure 3C:
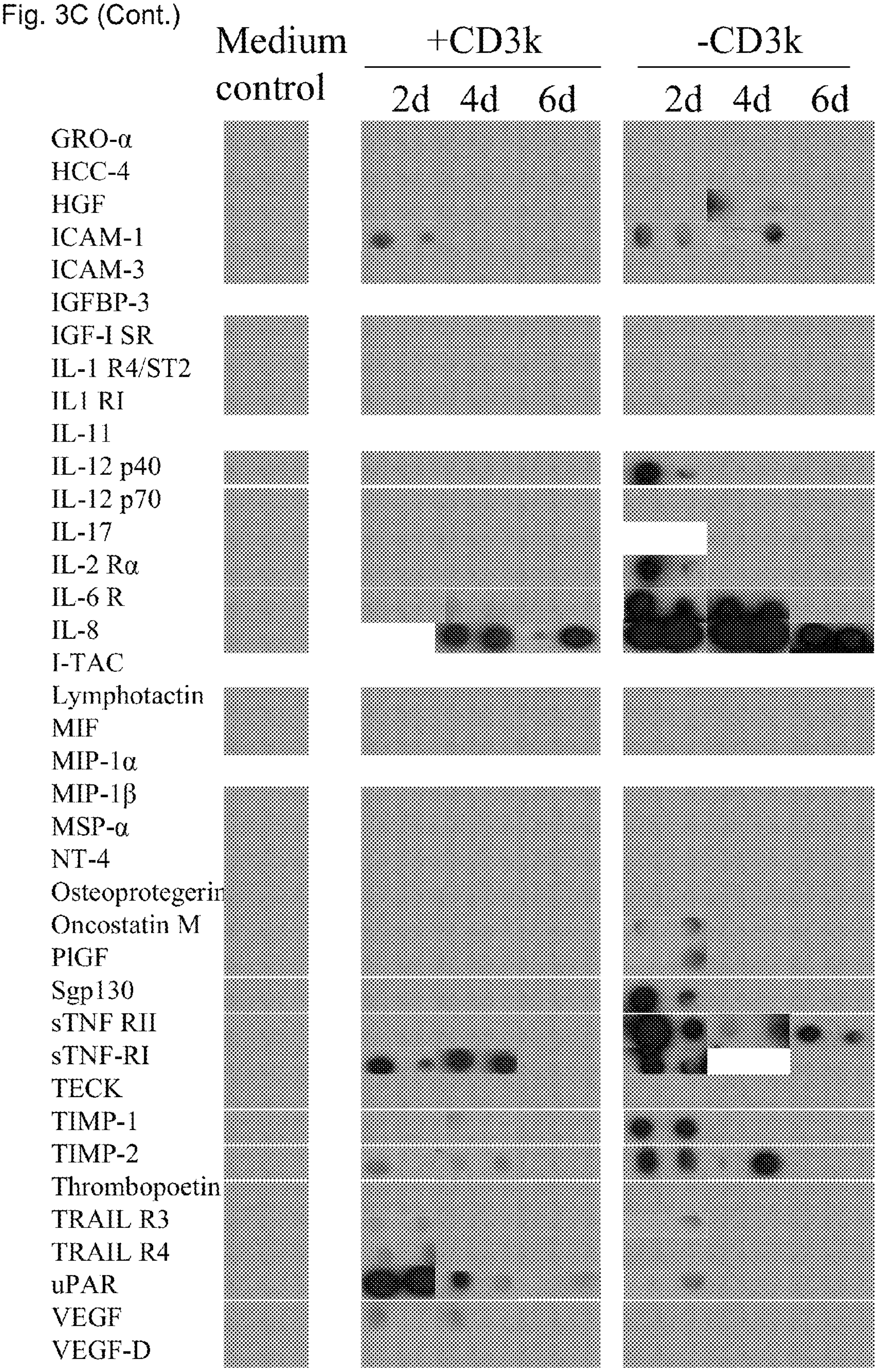

CD58 was down regulated. The expression of CD38, CD44, CD45RA, CD45RO, CD62L, CD95, HLA-ABC, HLA-DR, DP, DQ and LAIR was not changed and non-T-cell markers were not affected as may be taken from FIG. 4*a*. The amount of EGF, Eotaxin-2, I-309, IFNγ, IL-1α, IL-1β, IL-3, IL-6, NAP-2, TGFβ3 and PARC in the supernatant was increased after CD3-kappa treatment, while the amount of IL-1ra, IL-8, RANTES, SDF-1, TARC, MCP-4, GRO, soluble IL-6 Receptor and soluble TNF-Receptor II was decreased as may be taken from FIGS. 3*b* and 3*c*.

EXAMPLE 5

Figure 5:
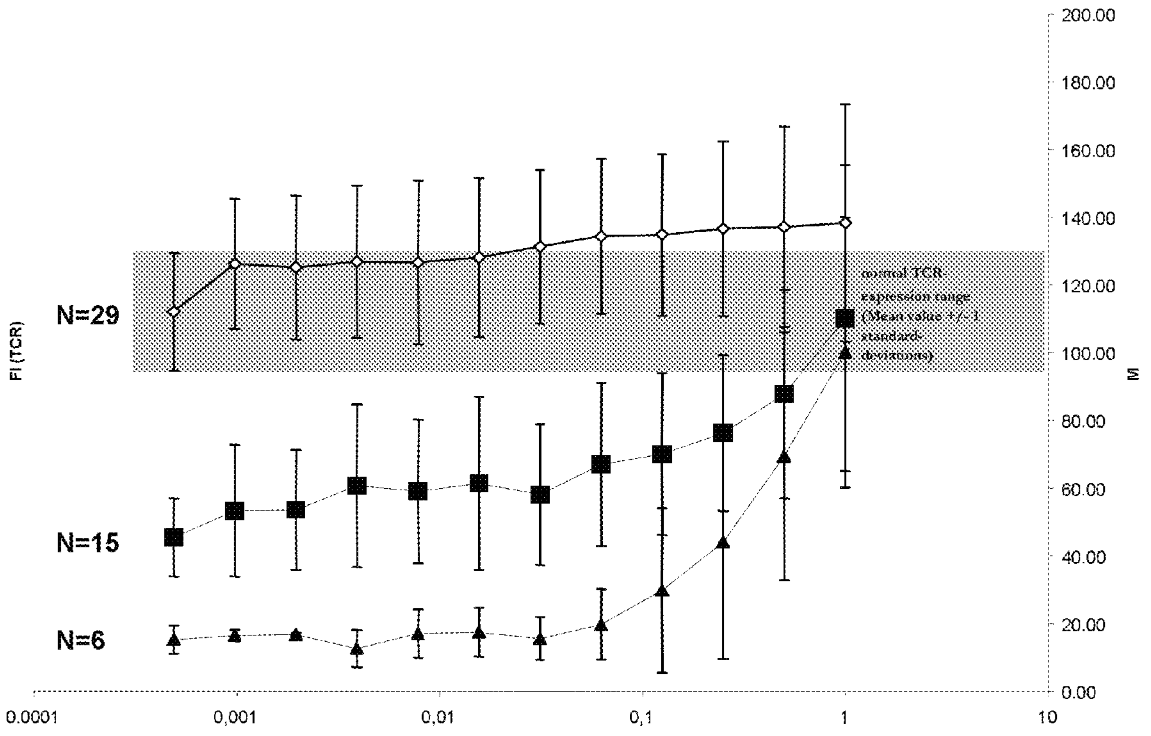
FIG. 5 is a histogram indicating the surface expression strength of CD4+ PBMCs form healthy controls and patients expressing TCR upon treatment with CD3 kappa, whereby 29 donors with normal expression range (o), 15 donors with a significantly reduced TCR-expression (■) and 6 donors with a even more significantly reduced TCR-expression due to high doses of cytostatic chemotherapy (▲) are shown.

Effect of CD3 Kappa on PBMCs from Patients Recovering from T-Cell Toxic Chemotherapy While CD3 kappa lead to a six-fold TCR upregulation in PBMCs from healthy donors, the analysis of CD3 kappa-associated TCR expression in PBMCs from patients recovering from treatment with the T-cell toxic chemotherapeutic agent fludarabine showed a dramatic decreased TCR expression which could be restored to normal levels by means of a 25-fold TCR upregulation after 48 h treatment with CD3 kappa as depicted in FIG. 5. CD3 zeta is synthesized at about 10% of the rate as the other CD3-complex proteins being the limiting component for a correct assembly of the CD3/TCR complex. A maximal upregulation of CD3 zeta can therefore result in a 10-fold upregulation of the TCR. The higher capability of CD3 kappa to upregulate the surface TCR expression might be explained with a reduced need of some of the CD3-complex components.

For the first time, we thus describe herein a molecular mechanism which may explain the increased avidity of cross-reactive T cells induced by heteroclitic peptide vaccination and possibly by molecular mimicry during autoimmune diseases. Our immune system is continuously being challenged by a myriad of pathogens, and there is a high likelihood that some of these antigens differ only slightly from self antigens. The detection of CD3kappa expressing cells in peripheral blood of normal individuals reflects such a situation with a small number of cross-reactive T cells with upregulated CD3kappa, while the predominance of CD3kappa bearing lymphocytes in the joint of arthritis patients reflects the expansion of a cross-reactive T-cell population. The demonstration of CD3kappa in peripheral blood lymphocytes stimulated with Dendritic cells might be due to the expansion of low affinity cross-reactive T cells, which cannot be supported in the absence of Dendritic cells. Moreover our findings support the use of CD3kappa and the derivatives described herein, including the nucleic acids coding therefore, as an adjuvant in vaccination against poorly immunogenic antigens.

The features of the present invention disclosed in the specification, the claims and/or the drawings may both separately and in any combination thereof be material for realizing the invention in various forms thereof.

SEQUENCE LISTING (4441 sequences)

SEQ ID NO: 1 - protein, 17 aa, Homo sapiens
YRASSLSNCRHTSSVEE

SEQ ID NO: 2 - DNA, 54 bp, Homo sapiens
taccgtgcaagttcattatcgaactgccgacacacaagctctgttgaggaatga

SEQ ID NO: 3 - DNA, 177 bp, Homo sapiens
atggaacatagcacgtttctctctggcctggtactggctacccttctctcgcaagtgagccccttcaagatacctatagaggaacttgaggacagagtgtttgtgaattgcaataccagcatctaccgtgcaagttcattatcgaactgccgacacacaagctctgttgaggaatga

SEQ ID NO: 4 - protein, 42 aa, Artificial Sequence
  chemically synthesized
SQVSPFKIPIEELEDRVFVNCNTSIYRASSLSNCRHTSSVEE

SEQ ID NO: 5 - protein, 42 aa, Artificial Sequence
  chemically synthesized
TQVSPFKIPIEELEDRVFVNCNTSIYRASSLSNCRHTSSVEE

SEQ ID NO: 6 - protein, 42 aa, Artificial Sequence
  chemically synthesized
YQVSPFKIPIEELEDRVFVNCNTSIYRASSLSNCRHTSSVEE

SEQ ID NO: 7 - protein, 42 aa, Artificial Sequence
  chemically synthesized
SNVSPFKIPIEELEDRVFVNCNTSIYRASSLSNCRHTSSVEE

SEQ ID NO: 8 - protein, 42 aa, Artificial Sequence
  chemically synthesized
SQLSPFKIPIEELEDRVFVNCNTSIYRASSLSNCRHTSSVEE

SEQ ID NO: 9 - protein, 42 aa, Artificial Sequence
  chemically synthesized
SQISPFKIPIEELEDRVFVNCNTSIYRASSLSNCRHTSSVEE

SEQ ID NO: 10 - protein, 42 aa, Artificial Sequence
  chemically synthesized
SQPSPFKIPIEELEDRVFVNCNTSIYRASSLSNCRHTSSVEE

SEQ ID NO: 11 - protein, 42 aa, Artificial Sequence
  chemically synthesized
SQFSPFKIPIEELEDRVFVNCNTSIYRASSLSNCRHTSSVEE

SEQ ID NO: 12 - protein, 42 aa, Artificial Sequence
  chemically synthesized
SQVTPFKIPIEELEDRVFVNCNTSIYRASSLSNCRHTSSVEE

SEQ ID NO: 13 - protein, 42 aa, Artificial Sequence
  chemically synthesized
SQVYPFKIPIEELEDRVFVNCNTSIYRASSLSNCRHTSSVEE

SEQ ID NO: 14 - protein, 42 aa, Artificial Sequence
  chemically synthesized
SQVSPWKIPIEELEDRVFVNCNTSIYRASSLSNCRHTSSVEE

SEQ ID NO: 15 - protein, 42 aa, Artificial Sequence
  chemically synthesized
SQVSPYKIPIEELEDRVFVNCNTSIYRASSLSNCRHTSSVEE

SEQ ID NO: 16 - protein, 42 aa, Artificial Sequence
  chemically synthesized
SQVSPHKIPIEELEDRVFVNCNTSIYRASSLSNCRHTSSVEE

SEQ ID NO: 17 - protein, 42 aa, Artificial Sequence
  chemically synthesized
SQVSPFRIPIEELEDRVFVNCNTSIYRASSLSNCRHTSSVEE

SEQ ID NO: 18 - protein, 42 aa, Artificial Sequence
  chemically synthesized
SQVSPFHIPIEELEDRVFVNCNTSIYRASSLSNCRHTSSVEE

SEQ ID NO: 19 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSLSNCRHTSSVEE

SEQ ID NO: 20 - protein, 42 aa, Artificial Sequence
  chemically synthesized
SQVSPFKLPIEELEDRVFVNCNTSIYRASSLSNCRHTSSVEE

SEQ ID NO: 21 - protein, 42 aa, Artificial Sequence
  chemically synthesized
SQVSPFKHPIEELEDRVFVNCNTSIYRASSLSNCRHTSSVEE

SEQ ID NO: 22 - protein, 42 aa, Artificial Sequence
  chemically synthesized
SQVSPFKVPIEELEDRVFVNCNTSIYRASSLSNCRHTSSVEE

SEQ ID NO: 23 - protein, 42 aa, Artificial Sequence
  chemically synthesized
SQVSPFKFPIEELEDRVFVNCNTSIYRASSLSNCRHTSSVEE

SEQ ID NO: 24 - protein, 42 aa, Artificial Sequence
  chemically synthesized
SQVSPFKMPIEELEDRVFVNCNTSIYRASSLSNCRHTSSVEE

SEQ ID NO: 25 - protein, 42 aa, Artificial Sequence
  chemically synthesized
SQVSPFKIPLEELEDRVFVNCNTSIYRASSLSNCRHTSSVEE

SEQ ID NO: 26 - protein, 42 aa, Artificial Sequence
  chemically synthesized
SQVSPFKIPHEELEDRVFVNCNTSIYRASSLSNCRHTSSVEE

SEQ ID NO: 27 - protein, 42 aa, Artificial Sequence
  chemically synthesized
SQVSPFKIPVEELEDRVFVNCNTSIYRASSLSNCRHTSSVEE

SEQ ID NO: 28 - protein, 42 aa, Artificial Sequence
  chemically synthesized
SQVSPFKIPFEELEDRVFVNCNTSIYRASSLSNCRHTSSVEE

SEQ ID NO: 29 - protein, 42 aa, Artificial Sequence
  chemically synthesized
SQVSPFKIPMEELEDRVFVNCNTSIYRASSLSNCRHTSSVEE

SEQ ID NO: 30 - protein, 42 aa, Artificial Sequence
  chemically synthesized
SQVSPFKIPIDELEDRVFVNCNTSIYRASSLSNCRHTSSVEE

SEQ ID NO: 31 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSLSNCRHTSSVEE

SEQ ID NO: 32 - protein, 42 aa, Artificial Sequence
  chemically synthesized
SQVSPFKIPIEDLEDRVFVNCNTSIYRASSLSNCRHTSSVEE

SEQ ID NO: 33 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSLSNCRHTSSVEE

SEQ ID NO: 34 - protein, 42 aa, Artificial Sequence
  chemically synthesized
SQVSPFKIPIEEVEDRVFVNCNTSIYRASSLSNCRHTSSVEE

SEQ ID NO: 35 - protein, 42 aa, Artificial Sequence
  chemically synthesized
SQVSPFKIPIEEIEDRVFVNCNTSIYRASSLSNCRHTSSVEE

SEQ ID NO: 36 - protein, 42 aa, Artificial Sequence
  chemically synthesized
SQVSPFKIPIEEFEDRVFVNCNTSIYRASSLSNCRHTSSVEE

SEQ ID NO: 37 - protein, 42 aa, Artificial Sequence
  chemically synthesized
SQVSPFKIPIEEHEDRVFVNCNTSIYRASSLSNCRHTSSVEE

SEQ ID NO: 38 - protein, 42 aa, Artificial Sequence
  chemically synthesized
SQVSPFKIPIEEMEDRVFVNCNTSIYRASSLSNCRHTSSVEE

SEQ ID NO: 39 - protein, 42 aa, Artificial Sequence
  chemically synthesized
SQVSPFKIPIEELDDRVFVNCNTSIYRASSLSNCRHTSSVEE

SEQ ID NO: 40 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASSLSNCRHTSSVEE

SEQ ID NO: 41 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSLSNCRHTSSVEE

SEQ ID NO: 42 - protein, 42 aa, Artificial Sequence
  chemically synthesized
SQVSPFKIPIEELEERVFVNCNTSIYRASSLSNCRHTSSVEE

SEQ ID NO: 43 - protein, 42 aa, Artificial Sequence
  chemically synthesized
SQVSPFKIPIEELEDKVFVNCNTSIYRASSLSNCRHTSSVEE

SEQ ID NO: 44 - protein, 42 aa, Artificial Sequence
  chemically synthesized
SQVSPFKIPIEELEDHVFVNCNTSIYRASSLSNCRHTSSVEE

SEQ ID NO: 45 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSLSNCRHTSSVEE

SEQ ID NO: 46 - protein, 42 aa, Artificial Sequence
  chemically synthesized
SQVSPFKIPIEELEDRIFVNCNTSIYRASSLSNCRHTSSVEE

SEQ ID NO: 47 - protein, 42 aa, Artificial Sequence
  chemically synthesized
SQVSPFKIPIEELEDRLFVNCNTSIYRASSLSNCRHTSSVEE

SEQ ID NO: 48 - protein, 42 aa, Artificial Sequence
  chemically synthesized
SQVSPFKIPIEELEDRFFVNCNTSIYRASSLSNCRHTSSVEE

SEQ ID NO: 49 - protein, 42 aa, Artificial Sequence
  chemically synthesized
SQVSPFKIPIEELEDRHFVNCNTSIYRASSLSNCRHTSSVEE

SEQ ID NO: 50 - protein, 42 aa, Artificial Sequence
  chemically synthesized
SQVSPFKIPIEELEDRMFVNCNTSIYRASSLSNCRHTSSVEE

SEQ ID NO: 51 - protein, 42 aa, Artificial Sequence
  chemically synthesized
SQVSPFKIPIEELEDRVIVNCNTSIYRASSLSNCRHTSSVEE

SEQ ID NO: 52 - protein, 42 aa, Artificial Sequence
  chemically synthesized
SQVSPFKIPIEELEDRVLVNCNTSIYRASSLSNCRHTSSVEE

SEQ ID NO: 53 - protein, 42 aa, Artificial Sequence
  chemically synthesized
SQVSPFKIPIEELEDRVVVNCNTSIYRASSLSNCRHTSSVEE

SEQ ID NO: 54 - protein, 42 aa, Artificial Sequence
  chemically synthesized
SQVSPFKIPIEELEDRVHVNCNTSIYRASSLSNCRHTSSVEE

SEQ ID NO: 55 - protein, 42 aa, Artificial Sequence
  chemically synthesized
SQVSPFKIPIEELEDRVMVNCNTSIYRASSLSNCRHTSSVEE

SEQ ID NO: 56 - protein, 42 aa, Artificial Sequence
  chemically synthesized
SQVSPFKIPIEELEDRVFINCNTSIYRASSLSNCRHTSSVEE

SEQ ID NO: 57 - protein, 42 aa, Artificial Sequence
  chemically synthesized
SQVSPFKIPIEELEDRVFLNCNTSIYRASSLSNCRHTSSVEE

SEQ ID NO: 58 - protein, 42 aa, Artificial Sequence
  chemically synthesized
SQVSPFKIPIEELEDRVFFNCNTSIYRASSLSNCRHTSSVEE

SEQ ID NO: 59 - protein, 42 aa, Artificial Sequence
  chemically synthesized
SQVSPFKIPIEELEDRVFHNCNTSIYRASSLSNCRHTSSVEE

SEQ ID NO: 60 - protein, 42 aa, Artificial Sequence
  chemically synthesized
SQVSPFKIPIEELEDRVFMNCNTSIYRASSLSNCRHTSSVEE

SEQ ID NO: 61 - protein, 42 aa, Artificial Sequence
  chemically synthesized
SQVSPFKIPIEELEDRVFVQCNTSIYRASSLSNCRHTSSVEE

SEQ ID NO: 62 - protein, 42 aa, Artificial Sequence
  chemically synthesized
SQVSPFKIPIEELEDRVFVNSNTSIYRASSLSNCRHTSSVEE

SEQ ID NO: 63 - protein, 42 aa, Artificial Sequence
  chemically synthesized
SQVSPFKIPIEELEDRVFVNGNTSIYRASSLSNCRHTSSVEE

SEQ ID NO: 64 - protein, 42 aa, Artificial Sequence
  chemically synthesized
SQVSPFKIPIEELEDRVFVNANTSIYRASSLSNCRHTSSVEE

SEQ ID NO: 65 - protein, 42 aa, Artificial Sequence
  chemically synthesized
SQVSPFKIPIEELEDRVFVNCQTSIYRASSLSNCRHTSSVEE

SEQ ID NO: 66 - protein, 42 aa, Artificial Sequence
  chemically synthesized
SQVSPFKIPIEELEDRVFVNCNSSIYRASSLSNCRHTSSVEE

SEQ ID NO: 67 - protein, 42 aa, Artificial Sequence
  chemically synthesized
SQVSPFKIPIEELEDRVFVNCNYSIYRASSLSNCRHTSSVEE

SEQ ID NO: 68 - protein, 42 aa, Artificial Sequence
  chemically synthesized
SQVSPFKIPIEELEDRVFVNCNTTIYRASSLSNCRHTSSVEE

SEQ ID NO: 69 - protein, 42 aa, Artificial Sequence
  chemically synthesized
SQVSPFKIPIEELEDRVFVNCNTYIYRASSLSNCRHTSSVEE

SEQ ID NO: 70 - protein, 42 aa, Artificial Sequence
  chemically synthesized
SQVSPFKIPIEELEDRVFVNCNTSVYRASSLSNCRHTSSVEE

SEQ ID NO: 71 - protein, 42 aa, Artificial Sequence
  chemically synthesized
SQVSPFKIPIEELEDRVFVNCNTSLYRASSLSNCRHTSSVEE

SEQ ID NO: 72 - protein, 42 aa, Artificial Sequence
  chemically synthesized
SQVSPFKIPIEELEDRVFVNCNTSHYRASSLSNCRHTSSVEE

SEQ ID NO: 73 - protein, 42 aa, Artificial Sequence
  chemically synthesized
SQVSPFKIPIEELEDRVFVNCNTSFYRASSLSNCRHTSSVEE

SEQ ID NO: 74 - protein, 42 aa, Artificial Sequence
  chemically synthesized
SQVSPFKIPIEELEDRVFVNCNTSMYRASSLSNCRHTSSVEE

SEQ ID NO: 75 - protein, 42 aa, Artificial Sequence
  chemically synthesized
SQVSPFKIPIEELEDRVFVNCNTSIWRASSLSNCRHTSSVEE

SEQ ID NO: 76 - protein, 42 aa, Artificial Sequence
  chemically synthesized
SQVSPFKIPIEELEDRVFVNCNTSIFRASSLSNCRHTSSVEE

SEQ ID NO: 77 - protein, 42 aa, Artificial Sequence
  chemically synthesized
SQVSPFKIPIEELEDRVFVNCNTSISRASSLSNCRHTSSVEE

SEQ ID NO: 78 - protein, 42 aa, Artificial Sequence
  chemically synthesized
SQVSPFKIPIEELEDRVFVNCNTSITRASSLSNCRHTSSVEE

SEQ ID NO: 79 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSLSNCRHTSSVEE

SEQ ID NO: 80 - protein, 42 aa, Artificial Sequence
  chemically synthesized
SQVSPFKIPIEELEDRVFVNCNTSIYHASSLSNCRHTSSVEE

SEQ ID NO: 81 - protein, 42 aa, Artificial Sequence
  chemically synthesized
SQVSPFKIPIEELEDRVFVNCNTSIYKASSLSNCRHTSSVEE

SEQ ID NO: 82 - protein, 42 aa, Artificial Sequence
  chemically synthesized
SQVSPFKIPIEELEDRVFVNCNTSIYRGSSLSNCRHTSSVEE

SEQ ID NO: 83 - protein, 42 aa, Artificial Sequence
  chemically synthesized
SQVSPFKIPIEELEDRVFVNCNTSIYRATSLSNCRHTSSVEE

SEQ ID NO: 84 - protein, 42 aa, Artificial Sequence
  chemically synthesized
SQVSPFKIPIEELEDRVFVNCNTSIYRAYSLSNCRHTSSVEE

SEQ ID NO: 85 - protein, 42 aa, Artificial Sequence
  chemically synthesized
SQVSPFKIPIEELEDRVFVNCNTSIYRASTLSNCRHTSSVEE

SEQ ID NO: 86 - protein, 42 aa, Artificial Sequence
  chemically synthesized
SQVSPFKIPIEELEDRVFVNCNTSIYRASYLSNCRHTSSVEE

SEQ ID NO: 87 - protein, 42 aa, Artificial Sequence
  chemically synthesized
SQVSPFKIPIEELEDRVFVNCNTSIYRASSISNCRHTSSVEE

SEQ ID NO: 88 - protein, 42 aa, Artificial Sequence
  chemically synthesized
SQVSPFKIPIEELEDRVFVNCNTSIYRASSVSNCRHTSSVEE

SEQ ID NO: 89 - protein, 42 aa, Artificial Sequence
  chemically synthesized
SQVSPFKIPIEELEDRVFVNCNTSIYRASSFSNCRHTSSVEE

SEQ ID NO: 90 - protein, 42 aa, Artificial Sequence
  chemically synthesized
SQVSPFKIPIEELEDRVFVNCNTSIYRASSMSNCRHTSSVEE

SEQ ID NO: 91 - protein, 42 aa, Artificial Sequence
  chemically synthesized
SQVSPFKIPIEELEDRVFVNCNTSIYRASSHSNCRHTSSVEE

SEQ ID NO: 92 - protein, 42 aa, Artificial Sequence
  chemically synthesized
SQVSPFKIPIEELEDRVFVNCNTSIYRASSLTNCRHTSSVEE

SEQ ID NO: 93 - protein, 42 aa, Artificial Sequence
  chemically synthesized
SQVSPFKIPIEELEDRVFVNCNTSIYRASSLYNCRHTSSVEE

SEQ ID NO: 94 - protein, 42 aa, Artificial Sequence
  chemically synthesized
SQVSPFKIPIEELEDRVFVNCNTSIYRASSLSQCRHTSSVEE

SEQ ID NO: 95 - protein, 42 aa, Artificial Sequence
  chemically synthesized
SQVSPFKIPIEELEDRVFVNCNTSIYRASSLSNSRHTSSVEE

SEQ ID NO: 96 - protein, 42 aa, Artificial Sequence
  chemically synthesized
SQVSPFKIPIEELEDRVFVNCNTSIYRASSLSNGRHTSSVEE

SEQ ID NO: 97 - protein, 42 aa, Artificial Sequence
  chemically synthesized
SQVSPFKIPIEELEDRVFVNCNTSIYRASSLSNARHTSSVEE

SEQ ID NO: 98 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRASSLSNCXHTSSVEE

SEQ ID NO: 99 - protein, 42 aa, Artificial Sequence
  chemically synthesized
SQVSPFKIPIEELEDRVFVNCNTSIYRASSLSNCHHTSSVEE

SEQ ID NO: 100 - protein, 42 aa, Artificial Sequence
  chemically synthesized
SQVSPFKIPIEELEDRVFVNCNTSIYRASSLSNCKHTSSVEE

SEQ ID NO: 101 - protein, 42 aa, Artificial Sequence
  chemically synthesized
SQVSPFKIPIEELEDRVFVNCNTSIYRASSLSNCRGTSSVEE

SEQ ID NO: 102 - protein, 42 aa, Artificial Sequence
  chemically synthesized
SQVSPFKIPIEELEDRVFVNCNTSIYRASSLSNCRATSSVEE

SEQ ID NO: 103 - protein, 42 aa, Artificial Sequence
  chemically synthesized
SQVSPFKIPIEELEDRVFVNCNTSIYRASSLSNCRITSSVEE

SEQ ID NO: 104 - protein, 42 aa, Artificial Sequence
  chemically synthesized
SQVSPFKIPIEELEDRVFVNCNTSIYRASSLSNCRLTSSVEE

SEQ ID NO: 105 - protein, 42 aa, Artificial Sequence
  chemically synthesized
SQVSPFKIPIEELEDRVFVNCNTSIYRASSLSNCRMTSSVEE

SEQ ID NO: 106 - protein, 42 aa, Artificial Sequence
  chemically synthesized
SQVSPFKIPIEELEDRVFVNCNTSIYRASSLSNCRVTSSVEE

SEQ ID NO: 107 - protein, 42 aa, Artificial Sequence
  chemically synthesized
SQVSPFKIPIEELEDRVFVNCNTSIYRASSLSNCRHSSSVEE

SEQ ID NO: 108 - protein, 42 aa, Artificial Sequence
  chemically synthesized
SQVSPFKIPIEELEDRVFVNCNTSIYRASSLSNCRHYSSVEE

SEQ ID NO: 109 - protein, 42 aa, Artificial Sequence
  chemically synthesized
SQVSPFKIPIEELEDRVFVNCNTSIYRASSLSNCRHTTSVEE

SEQ ID NO: 110 - protein, 42 aa, Artificial Sequence
  chemically synthesized
SQVSPFKIPIEELEDRVFVNCNTSIYRASSLSNCRHTYSVEE

SEQ ID NO: 111 - protein, 42 aa, Artificial Sequence
  chemically synthesized
SQVSPFKIPIEELEDRVFVNCNTSIYRASSLSNCRHTSTVEE

SEQ ID NO: 112 - protein, 42 aa, Artificial Sequence
  chemically synthesized
SQVSPFKIPIEELEDRVFVNCNTSIYRASSLSNCRHTSYVEE

SEQ ID NO: 113 - protein, 42 aa, Artificial Sequence
  chemically synthesized
SQVSPFKIPIEELEDRVFVNCNTSIYRASSLSNCRHTSSIEE

SEQ ID NO: 114 - protein, 42 aa, Artificial Sequence
  chemically synthesized
SQVSPFKIPIEELEDRVFVNCNTSIYRASSLSNCRHTSSLEE

SEQ ID NO: 115 - protein, 42 aa, Artificial Sequence
  chemically synthesized
SQVSPFKIPIEELEDRVFVNCNTSIYRASSLSNCRHTSSFEE

SEQ ID NO: 116 - protein, 42 aa, Artificial Sequence
  chemically synthesized
SQVSPFKIPIEELEDRVFVNCNTSIYRASSLSNCRHTSSHEE

SEQ ID NO: 117 - protein, 42 aa, Artificial Sequence
  chemically synthesized
SQVSPFKIPIEELEDRVFVNCNTSIYRASSLSNCRHTSSMEE

SEQ ID NO: 118 - protein, 42 aa, Artificial Sequence
  chemically synthesized
SQVSPFKIPIEELEDRVFVNCNTSIYRASSLSNCRHTSSVDE

SEQ ID NO: 119 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASSLSNCRHTSSVXE

SEQ ID NO: 120 - protein, 42 aa, Artificial Sequence
  chemically synthesized
SQVSPFKIPIEELEDRVFVNCNTSIYRASSLSNCRHTSSVED

SEQ ID NO: 121 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASSLSNCRHTSSVEX

SEQ ID NO: 122 - protein, 42 aa, Artificial Sequence
  chemically synthesized
SQVSAFKIPIEELEDRVFVNCNTSIYRASSLSNCRHTSSVEE

SEQ ID NO: 123 - protein, 42 aa, Artificial Sequence
  chemically synthesized
SQVSGFKIPIEELEDRVFVNCNTSIYRASSLSNCRHTSSVEE

SEQ ID NO: 124 - protein, 42 aa, Artificial Sequence
  chemically synthesized
SQVSPFKIAIEELEDRVFVNCNTSIYRASSLSNCRHTSSVEE

SEQ ID NO: 125 - protein, 42 aa, Artificial Sequence
  chemically synthesized
SQVSPFKIGIEELEDRVFVNCNTSIYRASSLSNCRHTSSVEE

SEQ ID NO: 126 - protein, 42 aa, Artificial Sequence
  chemically synthesized
TNVSPFKIPIEELEDRVFVNCNTSIYRASSLSNCRHTSSVEE

SEQ ID NO: 127 - protein, 42 aa, Artificial Sequence
  chemically synthesized
TQLSPFKIPIEELEDRVFVNCNTSIYRASSLSNCRHTSSVEE

SEQ ID NO: 128 - protein, 42 aa, Artificial Sequence
  chemically synthesized
TQISPFKIPIEELEDRVFVNCNTSIYRASSLSNCRHTSSVEE

SEQ ID NO: 129 - protein, 42 aa, Artificial Sequence
  chemically synthesized
TQPSPFKIPIEELEDRVFVNCNTSIYRASSLSNCRHTSSVEE

SEQ ID NO: 130 - protein, 42 aa, Artificial Sequence
  chemically synthesized
TQFSPFKIPIEELEDRVFVNCNTSIYRASSLSNCRHTSSVEE

SEQ ID NO: 131 - protein, 42 aa, Artificial Sequence
  chemically synthesized
TQVTPFKIPIEELEDRVFVNCNTSIYRASSLSNCRHTSSVEE

SEQ ID NO: 132 - protein, 42 aa, Artificial Sequence
  chemically synthesized
TQVYPFKIPIEELEDRVFVNCNTSIYRASSLSNCRHTSSVEE

SEQ ID NO: 133 - protein, 42 aa, Artificial Sequence
  chemically synthesized
TQVSPWKIPIEELEDRVFVNCNTSIYRASSLSNCRHTSSVEE

SEQ ID NO: 134 - protein, 42 aa, Artificial Sequence
  chemically synthesized
TQVSPYKIPIEELEDRVFVNCNTSIYRASSLSNCRHTSSVEE

SEQ ID NO: 135 - protein, 42 aa, Artificial Sequence
  chemically synthesized
TQVSPHKIPIEELEDRVFVNCNTSIYRASSLSNCRHTSSVEE

SEQ ID NO: 136 - protein, 42 aa, Artificial Sequence
  chemically synthesized
TQVSPFRIPIEELEDRVFVNCNTSIYRASSLSNCRHTSSVEE

SEQ ID NO: 137 - protein, 42 aa, Artificial Sequence
  chemically synthesized
TQVSPFHIPIEELEDRVFVNCNTSIYRASSLSNCRHTSSVEE

SEQ ID NO: 138 - protein, 42 aa, Artificial Sequence
  chemically synthesized
  misc_feature (7)..(7): Xaa can be a proteinogenic, non-proteinogenic or synthetic amino acid like ornithin or selenocystein
TQVSPFXIPIEELEDRVFVNCNTSIYRASSLSNCRHTSSVEE

SEQ ID NO: 139 - protein, 42 aa, Artificial Sequence
  chemically synthesized
TQVSPFKLPIEELEDRVFVNCNTSIYRASSLSNCRHTSSVEE

SEQ ID NO: 140 - protein, 42 aa, Artificial Sequence
  chemically synthesized
TQVSPFKHPIEELEDRVFVNCNTSIYRASSLSNCRHTSSVEE

SEQ ID NO: 141 - protein, 42 aa, Artificial Sequence
  chemically synthesized
TQVSPFKVPIEELEDRVFVNCNTSIYRASSLSNCRHTSSVEE

SEQ ID NO: 142 - protein, 42 aa, Artificial Sequence
  chemically synthesized
TQVSPFKFPIEELEDRVFVNCNTSIYRASSLSNCRHTSSVEE

SEQ ID NO: 143 - protein, 42 aa, Artificial Sequence
  chemically synthesized
TQVSPFKMPIEELEDRVFVNCNTSIYRASSLSNCRHTSSVEE

SEQ ID NO: 144 - protein, 42 aa, Artificial Sequence
  chemically synthesized
TQVSPFKIPLEELEDRVFVNCNTSIYRASSLSNCRHTSSVEE

SEQ ID NO: 145 - protein, 42 aa, Artificial Sequence
  chemically synthesized
TQVSPFKIPHEELEDRVFVNCNTSIYRASSLSNCRHTSSVEE

SEQ ID NO: 146 - protein, 42 aa, Artificial Sequence
  chemically synthesized
TQVSPFKIPVEELEDRVFVNCNTSIYRASSLSNCRHTSSVEE

SEQ ID NO: 147 - protein, 42 aa, Artificial Sequence
  chemically synthesized
TQVSPFKIPFEELEDRVFVNCNTSIYRASSLSNCRHTSSVEE

SEQ ID NO: 148 - protein, 42 aa, Artificial Sequence
  chemically synthesized
TQVSPFKIPMEELEDRVFVNCNTSIYRASSLSNCRHTSSVEE

SEQ ID NO: 149 - protein, 42 aa, Artificial Sequence
  chemically synthesized
TQVSPFKIPIDELEDRVFVNCNTSIYRASSLSNCRHTSSVEE

SEQ ID NO: 150 - protein, 42 aa, Artificial Sequence
  chemically synthesized
  misc_feature (11)..(11): Xaa can be a proteinogenic, non-proteinogenic or synthetic amino acid like ornithin or selenocystein
TQVSPFKIPIXELEDRVFVNCNTSIYRASSLSNCRHTSSVEE

SEQ ID NO: 151 - protein, 42 aa, Artificial Sequence
  chemically synthesized
TQVSPFKIPIEDLEDRVFVNCNTSIYRASSLSNCRHTSSVEE

SEQ ID NO: 152 - protein, 42 aa, Artificial Sequence
  chemically synthesized
  misc_feature (12)..(12): Xaa can be a proteinogenic, non-proteinogenic or synthetic amino acid like ornithin or selenocystein
TQVSPFKIPIEXLEDRVFVNCNTSIYRASSLSNCRHTSSVEE

SEQ ID NO: 153 - protein, 42 aa, Artificial Sequence
  chemically synthesized
TQVSPFKIPIEEVEDRVFVNCNTSIYRASSLSNCRHTSSVEE

SEQ ID NO: 154 - protein, 42 aa, Artificial Sequence
  chemically synthesized
TQVSPFKIPIEEIEDRVFVNCNTSIYRASSLSNCRHTSSVEE

SEQ ID NO: 155 - protein, 42 aa, Artificial Sequence
  chemically synthesized
TQVSPFKIPIEEFEDRVFVNCNTSIYRASSLSNCRHTSSVEE

SEQ ID NO: 156 - protein, 42 aa, Artificial Sequence
  chemically synthesized
TQVSPFKIPIEEHEDRVFVNCNTSIYRASSLSNCRHTSSVEE

SEQ ID NO: 157 - protein, 42 aa, Artificial Sequence
  chemically synthesized
TQVSPFKIPIEEMEDRVFVNCNTSIYRASSLSNCRHTSSVEE

SEQ ID NO: 158 - protein, 42 aa, Artificial Sequence
  chemically synthesized
TQVSPFKIPIEELDDRVFVNCNTSIYRASSLSNCRHTSSVEE

SEQ ID NO: 159 - protein, 42 aa, Artificial Sequence
  chemically synthesized
  misc_feature (14)..(14): Xaa can be a proteinogenic, non-proteinogenic or synthetic amino acid like ornithin or selenocystein
TQVSPFKIPIEELXDRVFVNCNTSIYRASSLSNCRHTSSVEE

SEQ ID NO: 160 - protein, 42 aa, Artificial Sequence
  chemically synthesized
  misc_feature (15)..(15): Xaa can be a proteinogenic, non-proteinogenic or synthetic amino acid like ornithin or selenocystein
TQVSPFKIPIEELEXRVFVNCNTSIYRASSLSNCRHTSSVEE

SEQ ID NO: 161 - protein, 42 aa, Artificial Sequence
  chemically synthesized
TQVSPFKIPIEELEERVFVNCNTSIYRASSLSNCRHTSSVEE

SEQ ID NO: 162 - protein, 42 aa, Artificial Sequence
  chemically synthesized
TQVSPFKIPIEELEDKVFVNCNTSIYRASSLSNCRHTSSVEE

SEQ ID NO: 163 - protein, 42 aa, Artificial Sequence
  chemically synthesized
TQVSPFKIPIEELEDHVFVNCNTSIYRASSLSNCRHTSSVEE

SEQ ID NO: 164 - protein, 42 aa, Artificial Sequence
  chemically synthesized
  misc_feature (16)..(16): Xaa can be a proteinogenic, non-proteinogenic or synthetic amino acid like ornithin or selenocystein
TQVSPFKIPIEELEDXVFVNCNTSIYRASSLSNCRHTSSVEE

SEQ ID NO: 165 - protein, 42 aa, Artificial Sequence
  chemically synthesized
TQVSPFKIPIEELEDRIFVNCNTSIYRASSLSNCRHTSSVEE

SEQ ID NO: 166 - protein, 42 aa, Artificial Sequence
  chemically synthesized
TQVSPFKIPIEELEDRLFVNCNTSIYRASSLSNCRHTSSVEE

SEQ ID NO: 167 - protein, 42 aa, Artificial Sequence
  chemically synthesized
TQVSPFKIPIEELEDRFFVNCNTSIYRASSLSNCRHTSSVEE

SEQ ID NO: 168 - protein, 42 aa, Artificial Sequence
  chemically synthesized
TQVSPFKIPIEELEDRHFVNCNTSIYRASSLSNCRHTSSVEE

SEQ ID NO: 169 - protein, 42 aa, Artificial Sequence
  chemically synthesized
TQVSPFKIPIEELEDRMFVNCNTSIYRASSLSNCRHTSSVEE

SEQ ID NO: 170 - protein, 42 aa, Artificial Sequence
  chemically synthesized
TQVSPFKIPIEELEDRVIVNCNTSIYRASSLSNCRHTSSVEE

SEQ ID NO: 171 - protein, 42 aa, Artificial Sequence
  chemically synthesized
TQVSPFKIPIEELEDRVLVNCNTSIYRASSLSNCRHTSSVEE

SEQ ID NO: 172 - protein, 42 aa, Artificial Sequence
  chemically synthesized
TQVSPFKIPIEELEDRVVVNCNTSIYRASSLSNCRHTSSVEE

SEQ ID NO: 173 - protein, 42 aa, Artificial Sequence
  chemically synthesized
TQVSPFKIPIEELEDRVHVNCNTSIYRASSLSNCRHTSSVEE

SEQ ID NO: 174 - protein, 42 aa, Artificial Sequence
  chemically synthesized
TQVSPFKIPIEELEDRVMVNCNTSIYRASSLSNCRHTSSVEE

SEQ ID NO: 175 - protein, 42 aa, Artificial Sequence
  chemically synthesized
TQVSPFKIPIEELEDRVFINCNTSIYRASSLSNCRHTSSVEE

SEQ ID NO: 176 - protein, 42 aa, Artificial Sequence
  chemically synthesized
TQVSPFKIPIEELEDRVFLNCNTSIYRASSLSNCRHTSSVEE

SEQ ID NO: 177 - protein, 42 aa, Artificial Sequence
  chemically synthesized
TQVSPFKIPIEELEDRVFFNCNTSIYRASSLSNCRHTSSVEE

SEQ ID NO: 178 - protein, 42 aa, Artificial Sequence
  chemically synthesized
TQVSPFKIPIEELEDRVFHNCNTSIYRASSLSNCRHTSSVEE

SEQ ID NO: 179 - protein, 42 aa, Artificial Sequence
  chemically synthesized
TQVSPFKIPIEELEDRVFMNCNTSIYRASSLSNCRHTSSVEE

SEQ ID NO: 180 - protein, 42 aa, Artificial Sequence
  chemically synthesized
TQVSPFKIPIEELEDRVFVQCNTSIYRASSLSNCRHTSSVEE

SEQ ID NO: 181 - protein, 42 aa, Artificial Sequence
  chemically synthesized
TQVSPFKIPIEELEDRVFVNSNTSIYRASSLSNCRHTSSVEE

SEQ ID NO: 182 - protein, 42 aa, Artificial Sequence
  chemically synthesized
TQVSPFKIPIEELEDRVFVNGNTSIYRASSLSNCRHTSSVEE

SEQ ID NO: 183 - protein, 42 aa, Artificial Sequence
  chemically synthesized
TQVSPFKIPIEELEDRVFVNANTSIYRASSLSNCRHTSSVEE

SEQ ID NO: 184 - protein, 42 aa, Artificial Sequence
  chemically synthesized
TQVSPFKIPIEELEDRVFVNCQTSIYRASSLSNCRHTSSVEE

SEQ ID NO: 185 - protein, 42 aa, Artificial Sequence
  chemically synthesized
TQVSPFKIPIEELEDRVFVNCNSSIYRASSLSNCRHTSSVEE

SEQ ID NO: 186 - protein, 42 aa, Artificial Sequence
  chemically synthesized
TQVSPFKIPIEELEDRVFVNCNYSIYRASSLSNCRHTSSVEE

SEQ ID NO: 187 - protein, 42 aa, Artificial Sequence
  chemically synthesized
TQVSPFKIPIEELEDRVFVNCNTTIYRASSLSNCRHTSSVEE

SEQ ID NO: 188 - protein, 42 aa, Artificial Sequence
  chemically synthesized
TQVSPFKIPIEELEDRVFVNCNTYIYRASSLSNCRHTSSVEE

SEQ ID NO: 189 - protein, 42 aa, Artificial Sequence
  chemically synthesized
TQVSPFKIPIEELEDRVFVNCNTSVYRASSLSNCRHTSSVEE

SEQ ID NO: 190 - protein, 42 aa, Artificial Sequence
  chemically synthesized
TQVSPFKIPIEELEDRVFVNCNTSLYRASSLSNCRHTSSVEE

SEQ ID NO: 191 - protein, 42 aa, Artificial Sequence
  chemically synthesized
TQVSPFKIPIEELEDRVFVNCNTSHYRASSLSNCRHTSSVEE

SEQ ID NO: 192 - protein, 42 aa, Artificial Sequence
  chemically synthesized
TQVSPFKIPIEELEDRVFVNCNTSFYRASSLSNCRHTSSVEE

SEQ ID NO: 193 - protein, 42 aa, Artificial Sequence
  chemically synthesized
TQVSPFKIPIEELEDRVFVNCNTSMYRASSLSNCRHTSSVEE

SEQ ID NO: 194 - protein, 42 aa, Artificial Sequence
  chemically synthesized
TQVSPFKIPIEELEDRVFVNCNTSIWRASSLSNCRHTSSVEE

SEQ ID NO: 195 - protein, 42 aa, Artificial Sequence
  chemically synthesized
TQVSPFKIPIEELEDRVFVNCNTSIFRASSLSNCRHTSSVEE

SEQ ID NO: 196 - protein, 42 aa, Artificial Sequence
  chemically synthesized
TQVSPFKIPIEELEDRVFVNCNTSISRASSLSNCRHTSSVEE

SEQ ID NO: 197 - protein, 42 aa, Artificial Sequence
  chemically synthesized
TQVSPFKIPIEELEDRVFVNCNTSITRASSLSNCRHTSSVEE

SEQ ID NO: 198 - protein, 42 aa, Artificial Sequence
  chemically synthesized
  misc_feature (27)..(27): Xaa can be a proteinogenic, non-proteinogenic or synthetic amino acid like ornithin or selenocystein
TQVSPFKIPIEELEDRVFVNCNTSIYXASSLSNCRHTSSVEE

SEQ ID NO: 199 - protein, 42 aa, Artificial Sequence
  chemically synthesized
TQVSPFKIPIEELEDRVFVNCNTSIYHASSLSNCRHTSSVEE

SEQ ID NO: 200 - protein, 42 aa, Artificial Sequence
  chemically synthesized
TQVSPFKIPIEELEDRVFVNCNTSIYKASSLSNCRHTSSVEE

SEQ ID NO: 201 - protein, 42 aa, Artificial Sequence
  chemically synthesized
TQVSPFKIPIEELEDRVFVNCNTSIYRGSSLSNCRHTSSVEE

SEQ ID NO: 202 - protein, 42 aa, Artificial Sequence
  chemically synthesized
TQVSPFKIPIEELEDRVFVNCNTSIYRATSLSNCRHTSSVEE

SEQ ID NO: 203 - protein, 42 aa, Artificial Sequence
  chemically synthesized
TQVSPFKIPIEELEDRVFVNCNTSIYRAYSLSNCRHTSSVEE

SEQ ID NO: 204 - protein, 42 aa, Artificial Sequence
  chemically synthesized
TQVSPFKIPIEELEDRVFVNCNTSIYRASTLSNCRHTSSVEE

SEQ ID NO: 205 - protein, 42 aa, Artificial Sequence
  chemically synthesized
TQVSPFKIPIEELEDRVFVNCNTSIYRASYLSNCRHTSSVEE

SEQ ID NO: 206 - protein, 42 aa, Artificial Sequence
  chemically synthesized
TQVSPFKIPIEELEDRVFVNCNTSIYRASSISNCRHTSSVEE

SEQ ID NO: 207 - protein, 42 aa, Artificial Sequence
  chemically synthesized
TQVSPFKIPIEELEDRVFVNCNTSIYRASSVSNCRHTSSVEE

SEQ ID NO: 208 - protein, 42 aa, Artificial Sequence
  chemically synthesized
TQVSPFKIPIEELEDRVFVNCNTSIYRASSFSNCRHTSSVEE

SEQ ID NO: 209 - protein, 42 aa, Artificial Sequence
  chemically synthesized
TQVSPFKIPIEELEDRVFVNCNTSIYRASSMSNCRHTSSVEE

SEQ ID NO: 210 - protein, 42 aa, Artificial Sequence
  chemically synthesized
TQVSPFKIPIEELEDRVFVNCNTSIYRASSHSNCRHTSSVEE

SEQ ID NO: 211 - protein, 42 aa, Artificial Sequence
  chemically synthesized
TQVSPFKIPIEELEDRVFVNCNTSIYRASSLTNCRHTSSVEE

SEQ ID NO: 212 - protein, 42 aa, Artificial Sequence
  chemically synthesized
TQVSPFKIPIEELEDRVFVNCNTSIYRASSLYNCRHTSSVEE

SEQ ID NO: 213 - protein, 42 aa, Artificial Sequence
  chemically synthesized
TQVSPFKIPIEELEDRVFVNCNTSIYRASSLSQCRHTSSVEE

SEQ ID NO: 214 - protein, 42 aa, Artificial Sequence
  chemically synthesized
TQVSPFKIPIEELEDRVFVNCNTSIYRASSLSNSRHTSSVEE

SEQ ID NO: 215 - protein, 42 aa, Artificial Sequence
  chemically synthesized
TQVSPFKIPIEELEDRVFVNCNTSIYRASSLSNGRHTSSVEE

SEQ ID NO: 216 - protein, 42 aa, Artificial Sequence
  chemically synthesized
TQVSPFKIPIEELEDRVFVNCNTSIYRASSLSNARHTSSVEE

SEQ ID NO: 217 - protein, 42 aa, Artificial Sequence
  chemically synthesized
  misc_feature (35)..(35): Xaa can be a proteinogenic, non-proteinogenic or synthetic amino acid like ornithin or selenocystein
TQVSPFKIPIEELEDRVFVNCNTSIYRASSLSNCXHTSSVEE

SEQ ID NO: 218 - protein, 42 aa, Artificial Sequence
  chemically synthesized
TQVSPFKIPIEELEDRVFVNCNTSIYRASSLSNCHHTSSVEE

SEQ ID NO: 219 - protein, 42 aa, Artificial Sequence
  chemically synthesized
TQVSPFKIPIEELEDRVFVNCNTSIYRASSLSNCKHTSSVEE

SEQ ID NO: 220 - protein, 42 aa, Artificial Sequence
  chemically synthesized
TQVSPFKIPIEELEDRVFVNCNTSIYRASSLSNCRGTSSVEE

SEQ ID NO: 221 - protein, 42 aa, Artificial Sequence
  chemically synthesized
TQVSPFKIPIEELEDRVFVNCNTSIYRASSLSNCRATSSVEE

SEQ ID NO: 222 - protein, 42 aa, Artificial Sequence
  chemically synthesized
TQVSPFKIPIEELEDRVFVNCNTSIYRASSLSNCRITSSVEE

SEQ ID NO: 223 - protein, 42 aa, Artificial Sequence
  chemically synthesized
TQVSPFKIPIEELEDRVFVNCNTSIYRASSLSNCRLTSSVEE

SEQ ID NO: 224 - protein, 42 aa, Artificial Sequence
  chemically synthesized
TQVSPFKIPIEELEDRVFVNCNTSIYRASSLSNCRMTSSVEE

SEQ ID NO: 225 - protein, 42 aa, Artificial Sequence
  chemically synthesized
TQVSPFKIPIEELEDRVFVNCNTSIYRASSLSNCRVTSSVEE

SEQ ID NO: 226 - protein, 42 aa, Artificial Sequence
  chemically synthesized
TQVSPFKIPIEELEDRVFVNCNTSIYRASSLSNCRHSSSVEE

SEQ ID NO: 227 - protein, 42 aa, Artificial Sequence
  chemically synthesized
TQVSPFKIPIEELEDRVFVNCNTSIYRASSLSNCRHYSSVEE

SEQ ID NO: 228 - protein, 42 aa, Artificial Sequence
  chemically synthesized
TQVSPFKIPIEELEDRVFVNCNTSIYRASSLSNCRHTTSVEE

SEQ ID NO: 229 - protein, 42 aa, Artificial Sequence
  chemically synthesized
TQVSPFKIPIEELEDRVFVNCNTSIYRASSLSNCRHTYSVEE

SEQ ID NO: 230 - protein, 42 aa, Artificial Sequence
  chemically synthesized
TQVSPFKIPIEELEDRVFVNCNTSIYRASSLSNCRHTSTVEE

SEQ ID NO: 231 - protein, 42 aa, Artificial Sequence
  chemically synthesized
TQVSPFKIPIEELEDRVFVNCNTSIYRASSLSNCRHTSYVEE

SEQ ID NO: 232 - protein, 42 aa, Artificial Sequence
  chemically synthesized
TQVSPFKIPIEELEDRVFVNCNTSIYRASSLSNCRHTSSIEE

SEQ ID NO: 233 - protein, 42 aa, Artificial Sequence
  chemically synthesized
TQVSPFKIPIEELEDRVFVNCNTSIYRASSLSNCRHTSSLEE

SEQ ID NO: 234 - protein, 42 aa, Artificial Sequence
  chemically synthesized
TQVSPFKIPIEELEDRVFVNCNTSIYRASSLSNCRHTSSFEE

SEQ ID NO: 235 - protein, 42 aa, Artificial Sequence
  chemically synthesized
TQVSPFKIPIEELEDRVFVNCNTSIYRASSLSNCRHTSSHEE

SEQ ID NO: 236 - protein, 42 aa, Artificial Sequence
  chemically synthesized
TQVSPFKIPIEELEDRVFVNCNTSIYRASSLSNCRHTSSMEE

SEQ ID NO: 237 - protein, 42 aa, Artificial Sequence
  chemically synthesized
TQVSPFKIPIEELEDRVFVNCNTSIYRASSLSNCRHTSSVDE

SEQ ID NO: 238 - protein, 42 aa, Artificial Sequence
  chemically synthesized
  misc_feature (41)..(41): Xaa can be a proteinogenic, non-proteinogenic or synthetic amino acid like ornithin or selenocystein
TQVSPFKIPIEELEDRVFVNCNTSIYRASSLSNCRHTSSVXE

SEQ ID NO: 239 - protein, 42 aa, Artificial Sequence
  chemically synthesized
TQVSPFKIPIEELEDRVFVNCNTSIYRASSLSNCRHTSSVED

SEQ ID NO: 240 - protein, 42 aa, Artificial Sequence
  chemically synthesized
  misc_feature (42)..(42): Xaa can be a proteinogenic, non-proteinogenic or synthetic amino acid like ornithin or selenocystein
TQVSPFKIPIEELEDRVFVNCNTSIYRASSLSNCRHTSSVEX

SEQ ID NO: 241 - protein, 42 aa, Artificial Sequence
  chemically synthesized
TQVSAFKIPIEELEDRVFVNCNTSIYRASSLSNCRHTSSVEE

SEQ ID NO: 242 - protein, 42 aa, Artificial Sequence
  chemically synthesized
TQVSGFKIPIEELEDRVFVNCNTSIYRASSLSNCRHTSSVEE

SEQ ID NO: 243 - protein, 42 aa, Artificial Sequence
  chemically synthesized
TQVSPFKIAIEELEDRVFVNCNTSIYRASSLSNCRHTSSVEE

SEQ ID NO: 244 - protein, 42 aa, Artificial Sequence
  chemically synthesized
TQVSPFKIGIEELEDRVFVNCNTSIYRASSLSNCRHTSSVEE

SEQ ID NO: 245 - protein, 42 aa, Artificial Sequence; identical to SEQ ID NO: 126
  chemically synthesized

SEQ ID NO: 246 - protein, 42 aa, Artificial Sequence
  chemically synthesized
YNVSPFKIPIEELEDRVFVNCNTSIYRASSLSNCRHTSSVEE

SEQ ID NO: 247 - protein, 42 aa, Artificial Sequence
  chemically synthesized
SNLSPFKIPIEELEDRVFVNCNTSIYRASSLSNCRHTSSVEE

SEQ ID NO: 248 - protein, 42 aa, Artificial Sequence
  chemically synthesized
SNISPFKIPIEELEDRVFVNCNTSIYRASSLSNCRHTSSVEE

SEQ ID NO: 249 - protein, 42 aa, Artificial Sequence
  chemically synthesized
SNPSPFKIPIEELEDRVFVNCNTSIYRASSLSNCRHTSSVEE

SEQ ID NO: 250 - protein, 42 aa, Artificial Sequence
  chemically synthesized
SNFSPFKIPIEELEDRVFVNCNTSIYRASSLSNCRHTSSVEE

SEQ ID NO: 251 - protein, 42 aa, Artificial Sequence
  chemically synthesized
SNVTPFKIPIEELEDRVFVNCNTSIYRASSLSNCRHTSSVEE

SEQ ID NO: 252 - protein, 42 aa, Artificial Sequence
  chemically synthesized
SNVYPFKIPIEELEDRVFVNCNTSIYRASSLSNCRHTSSVEE

SEQ ID NO: 253 - protein, 42 aa, Artificial Sequence
  chemically synthesized
SNVSPWKIPIEELEDRVFVNCNTSIYRASSLSNCRHTSSVEE

SEQ ID NO: 254 - protein, 42 aa, Artificial Sequence
  chemically synthesized
SNVSPYKIPIEELEDRVFVNCNTSIYRASSLSNCRHTSSVEE

SEQ ID NO: 255 - protein, 42 aa, Artificial Sequence
  chemically synthesized
SNVSPHKIPIEELEDRVFVNCNTSIYRASSLSNCRHTSSVEE

SEQ ID NO: 256 - protein, 42 aa, Artificial Sequence
  chemically synthesized
SNVSPFRIPIEELEDRVFVNCNTSIYRASSLSNCRHTSSVEE

SEQ ID NO: 257 - protein, 42 aa, Artificial Sequence
  chemically synthesized
SNVSPFHIPIEELEDRVFVNCNTSIYRASSLSNCRHTSSVEE

SEQ ID NO: 258 - protein, 42 aa, Artificial Sequence
  chemically synthesized
  misc_feature (7)..(7): Xaa can be a proteinogenic, non-proteinogenic or synthetic amino acid like ornithin or selenocystein
SNVSPFXIPIEELEDRVFVNCNTSIYRASSLSNCRHTSSVEE

SEQ ID NO: 259 - protein, 42 aa, Artificial Sequence
  chemically synthesized
SNVSPFKLPIEELEDRVFVNCNTSIYRASSLSNCRHTSSVEE

SEQ ID NO: 260 - protein, 42 aa, Artificial Sequence
  chemically synthesized
SNVSPFKHPIEELEDRVFVNCNTSIYRASSLSNCRHTSSVEE

SEQ ID NO: 261 - protein, 42 aa, Artificial Sequence
  chemically synthesized
SNVSPFKVPIEELEDRVFVNCNTSIYRASSLSNCRHTSSVEE

SEQ ID NO: 262 - protein, 42 aa, Artificial Sequence
  chemically synthesized
SNVSPFKFPIEELEDRVFVNCNTSIYRASSLSNCRHTSSVEE

SEQ ID NO: 263 - protein, 42 aa, Artificial Sequence
  chemically synthesized
SNVSPFKMPIEELEDRVFVNCNTSIYRASSLSNCRHTSSVEE

SEQ ID NO: 264 - protein, 42 aa, Artificial Sequence
  chemically synthesized
SNVSPFKIPLEELEDRVFVNCNTSIYRASSLSNCRHTSSVEE

SEQ ID NO: 265 - protein, 42 aa, Artificial Sequence
  chemically synthesized
SNVSPFKIPHEELEDRVFVNCNTSIYRASSLSNCRHTSSVEE

SEQ ID NO: 266 - protein, 42 aa, Artificial Sequence
  chemically synthesized
SNVSPFKIPVEELEDRVFVNCNTSIYRASSLSNCRHTSSVEE

SEQ ID NO: 267 - protein, 42 aa, Artificial Sequence
  chemically synthesized
SNVSPFKIPFEELEDRVFVNCNTSIYRASSLSNCRHTSSVEE

SEQ ID NO: 268 - protein, 42 aa, Artificial Sequence
  chemically synthesized
SNVSPFKIPMEELEDRVFVNCNTSIYRASSLSNCRHTSSVEE

SEQ ID NO: 269 - protein, 42 aa, Artificial Sequence
  chemically synthesized
SNVSPFKIPIDELEDRVFVNCNTSIYRASSLSNCRHTSSVEE

SEQ ID NO: 270 - protein, 42 aa, Artificial Sequence
  chemically synthesized
  misc_feature (11)..(11): Xaa can be a proteinogenic, non-proteinogenic or synthetic amino acid like ornithin or selenocystein
SNVSPFKIPIXELEDRVFVNCNTSIYRASSLSNCRHTSSVEE

SEQ ID NO: 271 - protein, 42 aa, Artificial Sequence
  chemically synthesized
SNVSPFKIPIEDLEDRVFVNCNTSIYRASSLSNCRHTSSVEE

SEQ ID NO: 272 - protein, 42 aa, Artificial Sequence
  chemically synthesized
  misc_feature (12)..(12): Xaa can be a proteinogenic, non-proteinogenic or synthetic amino acid like ornithin or selenocystein
SNVSPFKIPIEXLEDRVFVNCNTSIYRASSLSNCRHTSSVEE

SEQ ID NO: 273 - protein, 42 aa, Artificial Sequence
  chemically synthesized
SNVSPFKIPIEEVEDRVFVNCNTSIYRASSLSNCRHTSSVEE

SEQ ID NO: 274 - protein, 42 aa, Artificial Sequence
  chemically synthesized
SNVSPFKIPIEEIEDRVFVNCNTSIYRASSLSNCRHTSSVEE

SEQ ID NO: 275 - protein, 42 aa, Artificial Sequence
  chemically synthesized
SNVSPFKIPIEEFEDRVFVNCNTSIYRASSLSNCRHTSSVEE

SEQ ID NO: 276 - protein, 42 aa, Artificial Sequence
  chemically synthesized
SNVSPFKIPIEEHEDRVFVNCNTSIYRASSLSNCRHTSSVEE

SEQ ID NO: 277 - protein, 42 aa, Artificial Sequence
  chemically synthesized
SNVSPFKIPIEEMEDRVFVNCNTSIYRASSLSNCRHTSSVEE

SEQ ID NO: 278 - protein, 42 aa, Artificial Sequence
  chemically synthesized
SNVSPFKIPIEELDDRVFVNCNTSIYRASSLSNCRHTSSVEE

SEQ ID NO: 279 - protein, 42 aa, Artificial Sequence
  chemically synthesized
  misc_feature (14)..(14): Xaa can be a proteinogenic, non-proteinogenic or synthetic amino acid like ornithin or selenocystein
SNVSPFKIPIEELXDRVFVNCNTSIYRASSLSNCRHTSSVEE

SEQ ID NO: 280 - protein, 42 aa, Artificial Sequence
  chemically synthesized
  misc_feature (15)..(15): Xaa can be a proteinogenic, non-proteinogenic or synthetic amino acid like ornithin or selenocystein
SNVSPFKIPIEELEXRVFVNCNTSIYRASSLSNCRHTSSVEE

SEQ ID NO: 281 - protein, 42 aa, Artificial Sequence
  chemically synthesized
SNVSPFKIPIEELEERVFVNCNTSIYRASSLSNCRHTSSVEE

SEQ ID NO: 282 - protein, 42 aa, Artificial Sequence
  chemically synthesized
SNVSPFKIPIEELEDKVFVNCNTSIYRASSLSNCRHTSSVEE

SEQ ID NO: 283 - protein, 42 aa, Artificial Sequence
  chemically synthesized
SNVSPFKIPIEELEDHVFVNCNTSIYRASSLSNCRHTSSVEE

SEQ ID NO: 284 - protein, 42 aa, Artificial Sequence
  chemically synthesized
  misc_feature (16)..(16): Xaa can be a proteinogenic, non-proteinogenic or synthetic amino acid like ornithin or selenocystein
SNVSPFKIPIEELEDXVFVNCNTSIYRASSLSNCRHTSSVEE

SEQ ID NO: 285 - protein, 42 aa, Artificial Sequence
  chemically synthesized
SNVSPFKIPIEELEDRIFVNCNTSIYRASSLSNCRHTSSVEE

SEQ ID NO: 286 - protein, 42 aa, Artificial Sequence
  chemically synthesized
SNVSPFKIPIEELEDRLFVNCNTSIYRASSLSNCRHTSSVEE

SEQ ID NO: 287 - protein, 42 aa, Artificial Sequence
  chemically synthesized
SNVSPFKIPIEELEDRFFVNCNTSIYRASSLSNCRHTSSVEE

SEQ ID NO: 288 - protein, 42 aa, Artificial Sequence
  chemically synthesized
SNVSPFKIPIEELEDRHFVNCNTSIYRASSLSNCRHTSSVEE

SEQ ID NO: 289 - protein, 42 aa, Artificial Sequence
  chemically synthesized
SNVSPFKIPIEELEDRMFVNCNTSIYRASSLSNCRHTSSVEE

SEQ ID NO: 290 - protein, 42 aa, Artificial Sequence
  chemically synthesized
SNVSPFKIPIEELEDRVIVNCNTSIYRASSLSNCRHTSSVEE

SEQ ID NO: 291 - protein, 42 aa, Artificial Sequence
  chemically synthesized
SNVSPFKIPIEELEDRVLVNCNTSIYRASSLSNCRHTSSVEE

SEQ ID NO: 292 - protein, 42 aa, Artificial Sequence
  chemically synthesized
SNVSPFKIPIEELEDRVVVNCNTSIYRASSLSNCRHTSSVEE

SEQ ID NO: 293 - protein, 42 aa, Artificial Sequence
  chemically synthesized
SNVSPFKIPIEELEDRVHVNCNTSIYRASSLSNCRHTSSVEE

SEQ ID NO: 294 - protein, 42 aa, Artificial Sequence
  chemically synthesized
SNVSPFKIPIEELEDRVMVNCNTSIYRASSLSNCRHTSSVEE

SEQ ID NO: 295 - protein, 42 aa, Artificial Sequence
  chemically synthesized
SNVSPFKIPIEELEDRVFINCNTSIYRASSLSNCRHTSSVEE

SEQ ID NO: 296 - protein, 42 aa, Artificial Sequence
  chemically synthesized
SNVSPFKIPIEELEDRVFLNCNTSIYRASSLSNCRHTSSVEE

SEQ ID NO: 297 - protein, 42 aa, Artificial Sequence
  chemically synthesized
SNVSPFKIPIEELEDRVFFNCNTSIYRASSLSNCRHTSSVEE

SEQ ID NO: 298 - protein, 42 aa, Artificial Sequence
  chemically synthesized
SNVSPFKIPIEELEDRVFHNCNTSIYRASSLSNCRHTSSVEE

SEQ ID NO: 299 - protein, 42 aa, Artificial Sequence
  chemically synthesized
SNVSPFKIPIEELEDRVFMNCNTSIYRASSLSNCRHTSSVEE

SEQ ID NO: 300 - protein, 42 aa, Artificial Sequence
  chemically synthesized
SNVSPFKIPIEELEDRVFVQCNTSIYRASSLSNCRHTSSVEE

SEQ ID NO: 301 - protein, 42 aa, Artificial Sequence
  chemically synthesized
SNVSPFKIPIEELEDRVFVNSNTSIYRASSLSNCRHTSSVEE

SEQ ID NO: 302 - protein, 42 aa, Artificial Sequence
  chemically synthesized
SNVSPFKIPIEELEDRVFVNGNTSIYRASSLSNCRHTSSVEE

SEQ ID NO: 303 - protein, 42 aa, Artificial Sequence
  chemically synthesized
SNVSPFKIPIEELEDRVFVNANTSIYRASSLSNCRHTSSVEE

SEQ ID NO: 304 - protein, 42 aa, Artificial Sequence
  chemically synthesized
SNVSPFKIPIEELEDRVFVNCQTSIYRASSLSNCRHTSSVEE

SEQ ID NO: 305 - protein, 42 aa, Artificial Sequence
  chemically synthesized
SNVSPFKIPIEELEDRVFVNCNSSIYRASSLSNCRHTSSVEE

SEQ ID NO: 306 - protein, 42 aa, Artificial Sequence
  chemically synthesized
SNVSPFKIPIEELEDRVFVNCNYSIYRASSLSNCRHTSSVEE

SEQ ID NO: 307 - protein, 42 aa, Artificial Sequence
  chemically synthesized
SNVSPFKIPIEELEDRVFVNCNTTIYRASSLSNCRHTSSVEE

SEQ ID NO: 308 - protein, 42 aa, Artificial Sequence
  chemically synthesized
SNVSPFKIPIEELEDRVFVNCNTYIYRASSLSNCRHTSSVEE

SEQ ID NO: 309 - protein, 42 aa, Artificial Sequence
  chemically synthesized
SNVSPFKIPIEELEDRVFVNCNTSVYRASSLSNCRHTSSVEE

SEQ ID NO: 310 - protein, 42 aa, Artificial Sequence
  chemically synthesized
SNVSPFKIPIEELEDRVFVNCNTSLYRASSLSNCRHTSSVEE

SEQ ID NO: 311 - protein, 42 aa, Artificial Sequence
  chemically synthesized
SNVSPFKIPIEELEDRVFVNCNTSHYRASSLSNCRHTSSVEE

SEQ ID NO: 312 - protein, 42 aa, Artificial Sequence
  chemically synthesized
SNVSPFKIPIEELEDRVFVNCNTSFYRASSLSNCRHTSSVEE

SEQ ID NO: 313 - protein, 42 aa, Artificial Sequence
  chemically synthesized
SNVSPFKIPIEELEDRVFVNCNTSMYRASSLSNCRHTSSVEE

SEQ ID NO: 314 - protein, 42 aa, Artificial Sequence
  chemically synthesized
SNVSPFKIPIEELEDRVFVNCNTSIWRASSLSNCRHTSSVEE

SEQ ID NO: 315 - protein, 42 aa, Artificial Sequence
  chemically synthesized
SNVSPFKIPIEELEDRVFVNCNTSIFRASSLSNCRHTSSVEE

SEQ ID NO: 316 - protein, 42 aa, Artificial Sequence
  chemically synthesized
SNVSPFKIPIEELEDRVFVNCNTSISRASSLSNCRHTSSVEE

SEQ ID NO: 317 - protein, 42 aa, Artificial Sequence
  chemically synthesized
SNVSPFKIPIEELEDRVFVNCNTSITRASSLSNCRHTSSVEE

SEQ ID NO: 318 - protein, 42 aa, Artificial Sequence
  chemically synthesized
  misc_feature (27)..(27): Xaa can be a proteinogenic, non-proteinogenic or synthetic amino acid like ornithin or selenocystein
SNVSPFKIPIEELEDRVFVNCNTSIYXASSLSNCRHTSSVEE

SEQ ID NO: 319 - protein, 42 aa, Artificial Sequence
  chemically synthesized
SNVSPFKIPIEELEDRVFVNCNTSIYHASSLSNCRHTSSVEE

SEQ ID NO: 320 - protein, 42 aa, Artificial Sequence
  chemically synthesized
SNVSPFKIPIEELEDRVFVNCNTSIYKASSLSNCRHTSSVEE

SEQ ID NO: 321 - protein, 42 aa, Artificial Sequence
  chemically synthesized
SNVSPFKIPIEELEDRVFVNCNTSIYRGSSLSNCRHTSSVEE

SEQ ID NO: 322 - protein, 42 aa, Artificial Sequence
  chemically synthesized
SNVSPFKIPIEELEDRVFVNCNTSIYRATSLSNCRHTSSVEE

SEQ ID NO: 323 - protein, 42 aa, Artificial Sequence
  chemically synthesized
SNVSPFKIPIEELEDRVFVNCNTSIYRAYSLSNCRHTSSVEE

SEQ ID NO: 324 - protein, 42 aa, Artificial Sequence
  chemically synthesized
SNVSPFKIPIEELEDRVFVNCNTSIYRASTLSNCRHTSSVEE

SEQ ID NO: 325 - protein, 42 aa, Artificial Sequence
  chemically synthesized
SNVSPFKIPIEELEDRVFVNCNTSIYRASYLSNCRHTSSVEE

SEQ ID NO: 326 - protein, 42 aa, Artificial Sequence
  chemically synthesized
SNVSPFKIPIEELEDRVFVNCNTSIYRASSISNCRHTSSVEE

SEQ ID NO: 327 - protein, 42 aa, Artificial Sequence
  chemically synthesized
SNVSPFKIPIEELEDRVFVNCNTSIYRASSVSNCRHTSSVEE

SEQ ID NO: 328 - protein, 42 aa, Artificial Sequence
  chemically synthesized
SNVSPFKIPIEELEDRVFVNCNTSIYRASSFSNCRHTSSVEE

SEQ ID NO: 329 - protein, 42 aa, Artificial Sequence
  chemically synthesized
SNVSPFKIPIEELEDRVFVNCNTSIYRASSMSNCRHTSSVEE

SEQ ID NO: 330 - protein, 42 aa, Artificial Sequence
  chemically synthesized
SNVSPFKIPIEELEDRVFVNCNTSIYRASSHSNCRHTSSVEE

SEQ ID NO: 331 - protein, 42 aa, Artificial Sequence
  chemically synthesized
SNVSPFKIPIEELEDRVFVNCNTSIYRASSLTNCRHTSSVEE

SEQ ID NO: 332 - protein, 42 aa, Artificial Sequence
  chemically synthesized
SNVSPFKIPIEELEDRVFVNCNTSIYRASSLYNCRHTSSVEE

SEQ ID NO: 333 - protein, 42 aa, Artificial Sequence
  chemically synthesized
SNVSPFKIPIEELEDRVFVNCNTSIYRASSLSQCRHTSSVEE

SEQ ID NO: 334 - protein, 42 aa, Artificial Sequence
  chemically synthesized
SNVSPFKIPIEELEDRVFVNCNTSIYRASSLSNSRHTSSVEE

SEQ ID NO: 335 - protein, 42 aa, Artificial Sequence
  chemically synthesized
SNVSPFKIPIEELEDRVFVNCNTSIYRASSLSNGRHTSSVEE

SEQ ID NO: 336 - protein, 42 aa, Artificial Sequence
  chemically synthesized
SNVSPFKIPIEELEDRVFVNCNTSIYRASSLSNARHTSSVEE

SEQ ID NO: 337 - protein, 42 aa, Artificial Sequence
  chemically synthesized
  misc_feature (35)..(35): Xaa can be a proteinogenic, non-proteinogenic or synthetic amino acid like ornithin or selenocystein
SNVSPFKIPIEELEDRVFVNCNTSIYRASSLSNCXHTSSVEE

SEQ ID NO: 338 - protein, 42 aa, Artificial Sequence
  chemically synthesized
SNVSPFKIPIEELEDRVFVNCNTSIYRASSLSNCHHTSSVEE

SEQ ID NO: 339 - protein, 42 aa, Artificial Sequence
  chemically synthesized
SNVSPFKIPIEELEDRVFVNCNTSIYRASSLSNCKHTSSVEE

SEQ ID NO: 340 - protein, 42 aa, Artificial Sequence
  chemically synthesized
SNVSPFKIPIEELEDRVFVNCNTSIYRASSLSNCRGTSSVEE

SEQ ID NO: 341 - protein, 42 aa, Artificial Sequence
  chemically synthesized
SNVSPFKIPIEELEDRVFVNCNTSIYRASSLSNCRATSSVEE

SEQ ID NO: 342 - protein, 42 aa, Artificial Sequence
  chemically synthesized
SNVSPFKIPIEELEDRVFVNCNTSIYRASSLSNCRITSSVEE

SEQ ID NO: 343 - protein, 42 aa, Artificial Sequence
  chemically synthesized
SNVSPFKIPIEELEDRVFVNCNTSIYRASSLSNCRLTSSVEE

SEQ ID NO: 344 - protein, 42 aa, Artificial Sequence
  chemically synthesized
SNVSPFKIPIEELEDRVFVNCNTSIYRASSLSNCRMTSSVEE

SEQ ID NO: 345 - protein, 42 aa, Artificial Sequence
  chemically synthesized
SNVSPFKIPIEELEDRVFVNCNTSIYRASSLSNCRVTSSVEE

SEQ ID NO: 346 - protein, 42 aa, Artificial Sequence
  chemically synthesized
SNVSPFKIPIEELEDRVFVNCNTSIYRASSLSNCRHSSSVEE

SEQ ID NO: 347 - protein, 42 aa, Artificial Sequence
  chemically synthesized
SNVSPFKIPIEELEDRVFVNCNTSIYRASSLSNCRHYSSVEE

SEQ ID NO: 348 - protein, 42 aa, Artificial Sequence
  chemically synthesized
SNVSPFKIPIEELEDRVFVNCNTSIYRASSLSNCRHTTSVEE

SEQ ID NO: 349 - protein, 42 aa, Artificial Sequence
  chemically synthesized
SNVSPFKIPIEELEDRVFVNCNTSIYRASSLSNCRHTYSVEE

SEQ ID NO: 350 - protein, 42 aa, Artificial Sequence
  chemically synthesized
SNVSPFKIPIEELEDRVFVNCNTSIYRASSLSNCRHTSTVEE

SEQ ID NO: 351 - protein, 42 aa, Artificial Sequence
  chemically synthesized
SNVSPFKIPIEELEDRVFVNCNTSIYRASSLSNCRHTSYVEE

SEQ ID NO: 352 - protein, 42 aa, Artificial Sequence
  chemically synthesized
SNVSPFKIPIEELEDRVFVNCNTSIYRASSLSNCRHTSSIEE

SEQ ID NO: 353 - protein, 42 aa, Artificial Sequence
  chemically synthesized
SNVSPFKIPIEELEDRVFVNCNTSIYRASSLSNCRHTSSLEE

SEQ ID NO: 354 - protein, 42 aa, Artificial Sequence
  chemically synthesized
SNVSPFKIPIEELEDRVFVNCNTSIYRASSLSNCRHTSSFEE

SEQ ID NO: 355 - protein, 42 aa, Artificial Sequence
  chemically synthesized
SNVSPFKIPIEELEDRVFVNCNTSIYRASSLSNCRHTSSHEE

SEQ ID NO: 356 - protein, 42 aa, Artificial Sequence
  chemically synthesized
SNVSPFKIPIEELEDRVFVNCNTSIYRASSLSNCRHTSSMEE

SEQ ID NO: 357 - protein, 42 aa, Artificial Sequence
  chemically synthesized
SNVSPFKIPIEELEDRVFVNCNTSIYRASSLSNCRHTSSVDE

SEQ ID NO: 358 - protein, 42 aa, Artificial Sequence
  chemically synthesized
  misc_feature (41)..(41): Xaa can be a proteinogenic, non-proteinogenic or synthetic amino acid like ornithin or selenocystein
SNVSPFKIPIEELEDRVFVNCNTSIYRASSLSNCRHTSSVXE

SEQ ID NO: 359 - protein, 42 aa, Artificial Sequence
  chemically synthesized
SNVSPFKIPIEELEDRVFVNCNTSIYRASSLSNCRHTSSVED

SEQ ID NO: 360 - protein, 42 aa, Artificial Sequence
  chemically synthesized
  misc_feature (42)..(42): Xaa can be a proteinogenic, non-proteinogenic or synthetic amino acid like ornithin or selenocystein
SNVSPFKIPIEELEDRVFVNCNTSIYRASSLSNCRHTSSVEX

SEQ ID NO: 361 - protein, 42 aa, Artificial Sequence
  chemically synthesized
SNVSAFKIPIEELEDRVFVNCNTSIYRASSLSNCRHTSSVEE

SEQ ID NO: 362 - protein, 42 aa, Artificial Sequence
  chemically synthesized
SNVSGFKIPIEELEDRVFVNCNTSIYRASSLSNCRHTSSVEE

SEQ ID NO: 363 - protein, 42 aa, Artificial Sequence
  chemically synthesized
SNVSPFKIAIEELEDRVFVNCNTSIYRASSLSNCRHTSSVEE

SEQ ID NO: 364 - protein, 42 aa, Artificial Sequence
  chemically synthesized
SNVSPFKIGIEELEDRVFVNCNTSIYRASSLSNCRHTSSVEE

SEQ ID NO: 365 - protein, 42 aa, Artificial Sequence; identical to SEQ ID NO: 127
  chemically synthesized

SEQ ID NO: 366 - protein, 42 aa, Artificial Sequence
  chemically synthesized
YQLSPFKIPIEELEDRVFVNCNTSIYRASSLSNCRHTSSVEE

SEQ ID NO: 367 - protein, 42 aa, Artificial Sequence; identical to SEQ ID NO: 247
  chemically synthesized

SEQ ID NO: 368 - protein, 42 aa, Artificial Sequence; identical to SEQ ID NO: 8
  chemically synthesized

SEQ ID NO: 369 - protein, 42 aa, Artificial Sequence
  chemically synthesized
SQLTPFKIPIEELEDRVFVNCNTSIYRASSLSNCRHTSSVEE

SEQ ID NO: 370 - protein, 42 aa, Artificial Sequence
  chemically synthesized
SQLYPFKIPIEELEDRVFVNCNTSIYRASSLSNCRHTSSVEE

SEQ ID NO: 371 - protein, 42 aa, Artificial Sequence
  chemically synthesized
SQLSPWKIPIEELEDRVFVNCNTSIYRASSLSNCRHTSSVEE

SEQ ID NO: 372 - protein, 42 aa, Artificial Sequence
  chemically synthesized
SQLSPYKIPIEELEDRVFVNCNTSIYRASSLSNCRHTSSVEE

SEQ ID NO: 373 - protein, 42 aa, Artificial Sequence
  chemically synthesized
SQLSPHKIPIEELEDRVFVNCNTSIYRASSLSNCRHTSSVEE

SEQ ID NO: 374 - protein, 42 aa, Artificial Sequence
  chemically synthesized
SQLSPFRIPIEELEDRVFVNCNTSIYRASSLSNCRHTSSVEE

SEQ ID NO: 375 - protein, 42 aa, Artificial Sequence
  chemically synthesized
SQLSPFHIPIEELEDRVFVNCNTSIYRASSLSNCRHTSSVEE

SEQ ID NO: 376 - protein, 42 aa, Artificial Sequence
  chemically synthesized
  misc_feature (7)..(7): Xaa can be a proteinogenic, non-proteinogenic or synthetic amino acid like ornithin or selenocystein
SQLSPFXIPIEELEDRVFVNCNTSIYRASSLSNCRHTSSVEE

SEQ ID NO: 377 - protein, 42 aa, Artificial Sequence
  chemically synthesized
SQLSPFKLPIEELEDRVFVNCNTSIYRASSLSNCRHTSSVEE

SEQ ID NO: 378 - protein, 42 aa, Artificial Sequence
  chemically synthesized
SQLSPFKHPIEELEDRVFVNCNTSIYRASSLSNCRHTSSVEE

SEQ ID NO: 379 - protein, 42 aa, Artificial Sequence
  chemically synthesized
SQLSPFKVPIEELEDRVFVNCNTSIYRASSLSNCRHTSSVEE

SEQ ID NO: 380 - protein, 42 aa, Artificial Sequence
  chemically synthesized
SQLSPFKFPIEELEDRVFVNCNTSIYRASSLSNCRHTSSVEE

SEQ ID NO: 381 - protein, 42 aa, Artificial Sequence
  chemically synthesized
SQLSPFKMPIEELEDRVFVNCNTSIYRASSLSNCRHTSSVEE

SEQ ID NO: 382 - protein, 42 aa, Artificial Sequence
  chemically synthesized
SQLSPFKIPLEELEDRVFVNCNTSIYRASSLSNCRHTSSVEE

SEQ ID NO: 383 - protein, 42 aa, Artificial Sequence
  chemically synthesized
SQLSPFKIPHEELEDRVFVNCNTSIYRASSLSNCRHTSSVEE

SEQ ID NO: 384 - protein, 42 aa, Artificial Sequence
  chemically synthesized
SQLSPFKIPVEELEDRVFVNCNTSIYRASSLSNCRHTSSVEE

SEQ ID NO: 385 - protein, 42 aa, Artificial Sequence
  chemically synthesized
SQLSPFKIPFEELEDRVFVNCNTSIYRASSLSNCRHTSSVEE

SEQ ID NO: 386 - protein, 42 aa, Artificial Sequence
  chemically synthesized
SQLSPFKIPMEELEDRVFVNCNTSIYRASSLSNCRHTSSVEE

SEQ ID NO: 387 - protein, 42 aa, Artificial Sequence
  chemically synthesized
SQLSPFKIPIDELEDRVFVNCNTSIYRASSLSNCRHTSSVEE

SEQ ID NO: 388 - protein, 42 aa, Artificial Sequence
  chemically synthesized
  misc_feature (11)..(11): Xaa can be a proteinogenic, non-proteinogenic or synthetic amino acid like ornithin or selenocystein
SQLSPFKIPIXELEDRVFVNCNTSIYRASSLSNCRHTSSVEE

SEQ ID NO: 389 - protein, 42 aa, Artificial Sequence
  chemically synthesized
SQLSPFKIPIEDLEDRVFVNCNTSIYRASSLSNCRHTSSVEE

SEQ ID NO: 390 - protein, 42 aa, Artificial Sequence
  chemically synthesized
  misc_feature (12)..(12): Xaa can be a proteinogenic, non-proteinogenic or synthetic amino acid like ornithin or selenocystein
SQLSPFKIPIEXLEDRVFVNCNTSIYRASSLSNCRHTSSVEE

SEQ ID NO: 391 - protein, 42 aa, Artificial Sequence
  chemically synthesized
SQLSPFKIPIEEVEDRVFVNCNTSIYRASSLSNCRHTSSVEE

SEQ ID NO: 392 - protein, 42 aa, Artificial Sequence
  chemically synthesized
SQLSPFKIPIEEIEDRVFVNCNTSIYRASSLSNCRHTSSVEE

SEQ ID NO: 393 - protein, 42 aa, Artificial Sequence
  chemically synthesized
SQLSPFKIPIEEFEDRVFVNCNTSIYRASSLSNCRHTSSVEE

SEQ ID NO: 394 - protein, 42 aa, Artificial Sequence
  chemically synthesized
SQLSPFKIPIEEHEDRVFVNCNTSIYRASSLSNCRHTSSVEE

SEQ ID NO: 395 - protein, 42 aa, Artificial Sequence
  chemically synthesized
SQLSPFKIPIEEMEDRVFVNCNTSIYRASSLSNCRHTSSVEE

SEQ ID NO: 396 - protein, 42 aa, Artificial Sequence
  chemically synthesized
SQLSPFKIPIEELDDRVFVNCNTSIYRASSLSNCRHTSSVEE

SEQ ID NO: 397 - protein, 42 aa, Artificial Sequence
  chemically synthesized
  misc_feature (14)..(14): Xaa can be a proteinogenic, non-proteinogenic or synthetic amino acid like ornithin or selenocystein
SQLSPFKIPIEELXDRVFVNCNTSIYRASSLSNCRHTSSVEE

SEQ ID NO: 398 - protein, 42 aa, Artificial Sequence
  chemically synthesized
  misc_feature (15)..(15): Xaa can be a proteinogenic, non-proteinogenic or synthetic amino acid like ornithin or selenocystein
SQLSPFKIPIEELEXRVFVNCNTSIYRASSLSNCRHTSSVEE

SEQ ID NO: 399 - protein, 42 aa, Artificial Sequence
  chemically synthesized
SQLSPFKIPIEELEERVFVNCNTSIYRASSLSNCRHTSSVEE

SEQ ID NO: 400 - protein, 42 aa, Artificial Sequence
  chemically synthesized
SQLSPFKIPIEELEDKVFVNCNTSIYRASSLSNCRHTSSVEE

SEQ ID NO: 401 - protein, 42 aa, Artificial Sequence
  chemically synthesized
SQLSPFKIPIEELEDHVFVNCNTSIYRASSLSNCRHTSSVEE

SEQ ID NO: 402 - protein, 42 aa, Artificial Sequence
  chemically synthesized
  misc_feature (16)..(16): Xaa can be a proteinogenic, non-proteinogenic or synthetic amino acid like ornithin or selenocystein
SQLSPFKIPIEELEDXVFVNCNTSIYRASSLSNCRHTSSVEE

SEQ ID NO: 403 - protein, 42 aa, Artificial Sequence
  chemically synthesized
SQLSPFKIPIEELEDRIFVNCNTSIYRASSLSNCRHTSSVEE

SEQ ID NO: 404 - protein, 42 aa, Artificial Sequence
  chemically synthesized
SQLSPFKIPIEELEDRLFVNCNTSIYRASSLSNCRHTSSVEE

SEQ ID NO: 405 - protein, 42 aa, Artificial Sequence
  chemically synthesized
SQLSPFKIPIEELEDRFFVNCNTSIYRASSLSNCRHTSSVEE

SEQ ID NO: 406 - protein, 42 aa, Artificial Sequence
  chemically synthesized
SQLSPFKIPIEELEDRHFVNCNTSIYRASSLSNCRHTSSVEE

SEQ ID NO: 407 - protein, 42 aa, Artificial Sequence
  chemically synthesized
SQLSPFKIPIEELEDRMFVNCNTSIYRASSLSNCRHTSSVEE

SEQ ID NO: 408 - protein, 42 aa, Artificial Sequence
  chemically synthesized
SQLSPFKIPIEELEDRVIVNCNTSIYRASSLSNCRHTSSVEE

SEQ ID NO: 409 - protein, 42 aa, Artificial Sequence
  chemically synthesized
SQLSPFKIPIEELEDRVLVNCNTSIYRASSLSNCRHTSSVEE

SEQ ID NO: 410 - protein, 42 aa, Artificial Sequence
  chemically synthesized
SQLSPFKIPIEELEDRVVVNCNTSIYRASSLSNCRHTSSVEE

SEQ ID NO: 411 - protein, 42 aa, Artificial Sequence
  chemically synthesized
SQLSPFKIPIEELEDRVHVNCNTSIYRASSLSNCRHTSSVEE

SEQ ID NO: 412 - protein, 42 aa, Artificial Sequence
  chemically synthesized
SQLSPFKIPIEELEDRVMVNCNTSIYRASSLSNCRHTSSVEE

SEQ ID NO: 413 - protein, 42 aa, Artificial Sequence
  chemically synthesized
SQLSPFKIPIEELEDRVFINCNTSIYRASSLSNCRHTSSVEE

SEQ ID NO: 414 - protein, 42 aa, Artificial Sequence
  chemically synthesized
SQLSPFKIPIEELEDRVFLNCNTSIYRASSLSNCRHTSSVEE

SEQ ID NO: 415 - protein, 42 aa, Artificial Sequence
  chemically synthesized
SQLSPFKIPIEELEDRVFFNCNTSIYRASSLSNCRHTSSVEE

SEQ ID NO: 416 - protein, 42 aa, Artificial Sequence
  chemically synthesized
SQLSPFKIPIEELEDRVFHNCNTSIYRASSLSNCRHTSSVEE

SEQ ID NO: 417 - protein, 42 aa, Artificial Sequence
  chemically synthesized
SQLSPFKIPIEELEDRVFMNCNTSIYRASSLSNCRHTSSVEE

SEQ ID NO: 418 - protein, 42 aa, Artificial Sequence
  chemically synthesized
SQLSPFKIPIEELEDRVFVQCNTSIYRASSLSNCRHTSSVEE

SEQ ID NO: 419 - protein, 42 aa, Artificial Sequence
  chemically synthesized
SQLSPFKIPIEELEDRVFVNSNTSIYRASSLSNCRHTSSVEE

SEQ ID NO: 420 - protein, 42 aa, Artificial Sequence
  chemically synthesized
SQLSPFKIPIEELEDRVFVNGNTSIYRASSLSNCRHTSSVEE

SEQ ID NO: 421 - protein, 42 aa, Artificial Sequence
  chemically synthesized
SQLSPFKIPIEELEDRVFVNANTSIYRASSLSNCRHTSSVEE

SEQ ID NO: 422 - protein, 42 aa, Artificial Sequence
  chemically synthesized
SQLSPFKIPIEELEDRVFVNCQTSIYRASSLSNCRHTSSVEE

SEQ ID NO: 423 - protein, 42 aa, Artificial Sequence
  chemically synthesized
SQLSPFKIPIEELEDRVFVNCNSSIYRASSLSNCRHTSSVEE

SEQ ID NO: 424 - protein, 42 aa, Artificial Sequence
  chemically synthesized
SQLSPFKIPIEELEDRVFVNCNYSIYRASSLSNCRHTSSVEE

SEQ ID NO: 425 - protein, 42 aa, Artificial Sequence
  chemically synthesized
SQLSPFKIPIEELEDRVFVNCNTTIYRASSLSNCRHTSSVEE

SEQ ID NO: 426 - protein, 42 aa, Artificial Sequence
  chemically synthesized
SQLSPFKIPIEELEDRVFVNCNTYIYRASSLSNCRHTSSVEE

SEQ ID NO: 427 - protein, 42 aa, Artificial Sequence
  chemically synthesized
SQLSPFKIPIEELEDRVFVNCNTSVYRASSLSNCRHTSSVEE

SEQ ID NO: 428 - protein, 42 aa, Artificial Sequence
  chemically synthesized
SQLSPFKIPIEELEDRVFVNCNTSLYRASSLSNCRHTSSVEE

SEQ ID NO: 429 - protein, 42 aa, Artificial Sequence
  chemically synthesized
SQLSPFKIPIEELEDRVFVNCNTSHYRASSLSNCRHTSSVEE

SEQ ID NO: 430 - protein, 42 aa, Artificial Sequence
  chemically synthesized
SQLSPFKIPIEELEDRVFVNCNTSFYRASSLSNCRHTSSVEE

SEQ ID NO: 431 - protein, 42 aa, Artificial Sequence
  chemically synthesized
SQLSPFKIPIEELEDRVFVNCNTSMYRASSLSNCRHTSSVEE

SEQ ID NO: 432 - protein, 42 aa, Artificial Sequence
  chemically synthesized
SQLSPFKIPIEELEDRVFVNCNTSIWRASSLSNCRHTSSVEE

SEQ ID NO: 433 - protein, 42 aa, Artificial Sequence
  chemically synthesized
SQLSPFKIPIEELEDRVFVNCNTSIFRASSLSNCRHTSSVEE

SEQ ID NO: 434 - protein, 42 aa, Artificial Sequence
  chemically synthesized
SQLSPFKIPIEELEDRVFVNCNTSISRASSLSNCRHTSSVEE

SEQ ID NO: 435 - protein, 42 aa, Artificial Sequence
  chemically synthesized
SQLSPFKIPIEELEDRVFVNCNTSITRASSLSNCRHTSSVEE

SEQ ID NO: 436 - protein, 42 aa, Artificial Sequence
  chemically synthesized
  misc_feature (27)..(27): Xaa can be a proteinogenic, non-proteinogenic or synthetic amino acid like ornithin or selenocystein
SQLSPFKIPIEELEDRVFVNCNTSIYXASSLSNCRHTSSVEE

SEQ ID NO: 437 - protein, 42 aa, Artificial Sequence
  chemically synthesized
SQLSPFKIPIEELEDRVFVNCNTSIYHASSLSNCRHTSSVEE

SEQ ID NO: 438 - protein, 42 aa, Artificial Sequence
  chemically synthesized
SQLSPFKIPIEELEDRVFVNCNTSIYKASSLSNCRHTSSVEE

SEQ ID NO: 439 - protein, 42 aa, Artificial Sequence
  chemically synthesized
SQLSPFKIPIEELEDRVFVNCNTSIYRGSSLSNCRHTSSVEE

SEQ ID NO: 440 - protein, 42 aa, Artificial Sequence
  chemically synthesized
SQLSPFKIPIEELEDRVFVNCNTSIYRATSLSNCRHTSSVEE

SEQ ID NO: 441 - protein, 42 aa, Artificial Sequence
  chemically synthesized
SQLSPFKIPIEELEDRVFVNCNTSIYRAYSLSNCRHTSSVEE

SEQ ID NO: 442 - protein, 42 aa, Artificial Sequence
  chemically synthesized
SQLSPFKIPIEELEDRVFVNCNTSIYRASTLSNCRHTSSVEE

SEQ ID NO: 443 - protein, 42 aa, Artificial Sequence
  chemically synthesized
SQLSPFKIPIEELEDRVFVNCNTSIYRASYLSNCRHTSSVEE

SEQ ID NO: 444 - protein, 42 aa, Artificial Sequence
  chemically synthesized
SQLSPFKIPIEELEDRVFVNCNTSIYRASSISNCRHTSSVEE

SEQ ID NO: 445 - protein, 42 aa, Artificial Sequence
  chemically synthesized
SQLSPFKIPIEELEDRVFVNCNTSIYRASSVSNCRHTSSVEE

SEQ ID NO: 446 - protein, 42 aa, Artificial Sequence
  chemically synthesized
SQLSPFKIPIEELEDRVFVNCNTSIYRASSFSNCRHTSSVEE

SEQ ID NO: 447 - protein, 42 aa, Artificial Sequence
  chemically synthesized
SQLSPFKIPIEELEDRVFVNCNTSIYRASSMSNCRHTSSVEE

SEQ ID NO: 448 - protein, 42 aa, Artificial Sequence
  chemically synthesized
SQLSPFKIPIEELEDRVFVNCNTSIYRASSHSNCRHTSSVEE

SEQ ID NO: 449 - protein, 42 aa, Artificial Sequence
  chemically synthesized
SQLSPFKIPIEELEDRVFVNCNTSIYRASSLTNCRHTSSVEE

SEQ ID NO: 450 - protein, 42 aa, Artificial Sequence
  chemically synthesized
SQLSPFKIPIEELEDRVFVNCNTSIYRASSLYNCRHTSSVEE

SEQ ID NO: 451 - protein, 42 aa, Artificial Sequence
  chemically synthesized
SQLSPFKIPIEELEDRVFVNCNTSIYRASSLSQCRHTSSVEE

SEQ ID NO: 452 - protein, 42 aa, Artificial Sequence
  chemically synthesized
SQLSPFKIPIEELEDRVFVNCNTSIYRASSLSNSRHTSSVEE

SEQ ID NO: 453 - protein, 42 aa, Artificial Sequence
  chemically synthesized
SQLSPFKIPIEELEDRVFVNCNTSIYRASSLSNGRHTSSVEE

SEQ ID NO: 454 - protein, 42 aa, Artificial Sequence
  chemically synthesized
SQLSPFKIPIEELEDRVFVNCNTSIYRASSLSNARHTSSVEE

SEQ ID NO: 455 - protein, 42 aa, Artificial Sequence
  chemically synthesized
  misc_feature (35)..(35): Xaa can be a proteinogenic, non-proteinogenic or synthetic amino acid like ornithin or selenocystein
SQLSPFKIPIEELEDRVFVNCNTSIYRASSLSNCXHTSSVEE

SEQ ID NO: 456 - protein, 42 aa, Artificial Sequence
  chemically synthesized
SQLSPFKIPIEELEDRVFVNCNTSIYRASSLSNCHHTSSVEE

SEQ ID NO: 457 - protein, 42 aa, Artificial Sequence
  chemically synthesized
SQLSPFKIPIEELEDRVFVNCNTSIYRASSLSNCKHTSSVEE

SEQ ID NO: 458 - protein, 42 aa, Artificial Sequence
  chemically synthesized
SQLSPFKIPIEELEDRVFVNCNTSIYRASSLSNCRGTSSVEE

SEQ ID NO: 459 - protein, 42 aa, Artificial Sequence
  chemically synthesized
SQLSPFKIPIEELEDRVFVNCNTSIYRASSLSNCRATSSVEE

SEQ ID NO: 460 - protein, 42 aa, Artificial Sequence
  chemically synthesized
SQLSPFKIPIEELEDRVFVNCNTSIYRASSLSNCRITSSVEE

SEQ ID NO: 461 - protein, 42 aa, Artificial Sequence
  chemically synthesized
SQLSPFKIPIEELEDRVFVNCNTSIYRASSLSNCRLTSSVEE

SEQ ID NO: 462 - protein, 42 aa, Artificial Sequence
  chemically synthesized
SQLSPFKIPIEELEDRVFVNCNTSIYRASSLSNCRMTSSVEE

SEQ ID NO: 463 - protein, 42 aa, Artificial Sequence
  chemically synthesized
SQLSPFKIPIEELEDRVFVNCNTSIYRASSLSNCRVTSSVEE

SEQ ID NO: 464 - protein, 42 aa, Artificial Sequence
  chemically synthesized
SQLSPFKIPIEELEDRVFVNCNTSIYRASSLSNCRHSSSVEE

SEQ ID NO: 465 - protein, 42 aa, Artificial Sequence
  chemically synthesized
SQLSPFKIPIEELEDRVFVNCNTSIYRASSLSNCRHYSSVEE

SEQ ID NO: 466 - protein, 42 aa, Artificial Sequence
  chemically synthesized
SQLSPFKIPIEELEDRVFVNCNTSIYRASSLSNCRHTTSVEE

SEQ ID NO: 467 - protein, 42 aa, Artificial Sequence
  chemically synthesized
SQLSPFKIPIEELEDRVFVNCNTSIYRASSLSNCRHTYSVEE

SEQ ID NO: 468 - protein, 42 aa, Artificial Sequence
  chemically synthesized
SQLSPFKIPIEELEDRVFVNCNTSIYRASSLSNCRHTSTVEE

SEQ ID NO: 469 - protein, 42 aa, Artificial Sequence
  chemically synthesized
SQLSPFKIPIEELEDRVFVNCNTSIYRASSLSNCRHTSYVEE

SEQ ID NO: 470 - protein, 42 aa, Artificial Sequence
  chemically synthesized
SQLSPFKIPIEELEDRVFVNCNTSIYRASSLSNCRHTSSIEE

SEQ ID NO: 471 - protein, 42 aa, Artificial Sequence
  chemically synthesized
SQLSPFKIPIEELEDRVFVNCNTSIYRASSLSNCRHTSSLEE

SEQ ID NO: 472 - protein, 42 aa, Artificial Sequence
  chemically synthesized
SQLSPFKIPIEELEDRVFVNCNTSIYRASSLSNCRHTSSFEE

SEQ ID NO: 473 - protein, 42 aa, Artificial Sequence
  chemically synthesized
SQLSPFKIPIEELEDRVFVNCNTSIYRASSLSNCRHTSSHEE

SEQ ID NO: 474 - protein, 42 aa, Artificial Sequence
  chemically synthesized
SQLSPFKIPIEELEDRVFVNCNTSIYRASSLSNCRHTSSMEE

SEQ ID NO: 475 - protein, 42 aa, Artificial Sequence
  chemically synthesized
SQLSPFKIPIEELEDRVFVNCNTSIYRASSLSNCRHTSSVDE

SEQ ID NO: 476 - protein, 42 aa, Artificial Sequence
  chemically synthesized
  misc_feature (41)..(41): Xaa can be a proteinogenic, non-proteinogenic or synthetic amino acid like ornithin or selenocystein
SQLSPFKIPIEELEDRVFVNCNTSIYRASSLSNCRHTSSVXE

SEQ ID NO: 477 - protein, 42 aa, Artificial Sequence
  chemically synthesized
SQLSPFKIPIEELEDRVFVNCNTSIYRASSLSNCRHTSSVED

SEQ ID NO: 478 - protein, 42 aa, Artificial Sequence
  chemically synthesized
  misc_feature (42)..(42): Xaa can be a proteinogenic, non-proteinogenic or synthetic amino acid like ornithin or selenocystein
SQLSPFKIPIEELEDRVFVNCNTSIYRASSLSNCRHTSSVEX

SEQ ID NO: 479 - protein, 42 aa, Artificial Sequence
  chemically synthesized
SQLSAFKIPIEELEDRVFVNCNTSIYRASSLSNCRHTSSVEE

SEQ ID NO: 480 - protein, 42 aa, Artificial Sequence
  chemically synthesized
SQLSGFKIPIEELEDRVFVNCNTSIYRASSLSNCRHTSSVEE

SEQ ID NO: 481 - protein, 42 aa, Artificial Sequence
  chemically synthesized
SQLSPFKIAIEELEDRVFVNCNTSIYRASSLSNCRHTSSVEE

SEQ ID NO: 482 - protein, 42 aa, Artificial Sequence
  chemically synthesized
SQLSPFKIGIEELEDRVFVNCNTSIYRASSLSNCRHTSSVEE

SEQ ID NO: 483 - protein, 42 aa, Artificial Sequence; identical to SEQ ID NO: 131
  chemically synthesized

SEQ ID NO: 484 - protein, 42 aa, Artificial Sequence
  chemically synthesized
YQVTPFKIPIEELEDRVFVNCNTSIYRASSLSNCRHTSSVEE

SEQ ID NO: 485 - protein, 42 aa, Artificial Sequence; identical to SEQ ID NO: 251
  chemically synthesized

SEQ ID NO: 486 - protein, 42 aa, Artificial Sequence; identical to SEQ ID NO: 369
  chemically synthesized

SEQ ID NO: 487 - protein, 42 aa, Artificial Sequence
  chemically synthesized
SQITPFKIPIEELEDRVFVNCNTSIYRASSLSNCRHTSSVEE

SEQ ID NO: 488 - protein, 42 aa, Artificial Sequence
  chemically synthesized
SQPTPFKIPIEELEDRVFVNCNTSIYRASSLSNCRHTSSVEE

SEQ ID NO: 489 - protein, 42 aa, Artificial Sequence
  chemically synthesized
SQFTPFKIPIEELEDRVFVNCNTSIYRASSLSNCRHTSSVEE

SEQ ID NO: 490 - protein, 42 aa, Artificial Sequence
  chemically synthesized
SQVTPWKIPIEELEDRVFVNCNTSIYRASSLSNCRHTSSVEE

SEQ ID NO: 491 - protein, 42 aa, Artificial Sequence
  chemically synthesized
SQVTPYKIPIEELEDRVFVNCNTSIYRASSLSNCRHTSSVEE

SEQ ID NO: 492 - protein, 42 aa, Artificial Sequence
  chemically synthesized
SQVTPHKIPIEELEDRVFVNCNTSIYRASSLSNCRHTSSVEE

SEQ ID NO: 493 - protein, 42 aa, Artificial Sequence
  chemically synthesized
SQVTPFRIPIEELEDRVFVNCNTSIYRASSLSNCRHTSSVEE

SEQ ID NO: 494 - protein, 42 aa, Artificial Sequence
  chemically synthesized
SQVTPFHIPIEELEDRVFVNCNTSIYRASSLSNCRHTSSVEE

SEQ ID NO: 495 - protein, 42 aa, Artificial Sequence
  chemically synthesized
  misc_feature (7)..(7): Xaa can be a proteinogenic, non-proteinogenic or synthetic amino acid like ornithin or selenocystein
SQVTPFXIPIEELEDRVFVNCNTSIYRASSLSNCRHTSSVEE

SEQ ID NO: 496 - protein, 42 aa, Artificial Sequence
  chemically synthesized
SQVTPFKLPIEELEDRVFVNCNTSIYRASSLSNCRHTSSVEE

SEQ ID NO: 497 - protein, 42 aa, Artificial Sequence
  chemically synthesized
SQVTPFKHPIEELEDRVFVNCNTSIYRASSLSNCRHTSSVEE

SEQ ID NO: 498 - protein, 42 aa, Artificial Sequence
  chemically synthesized
SQVTPFKVPIEELEDRVFVNCNTSIYRASSLSNCRHTSSVEE

SEQ ID NO: 499 - protein, 42 aa, Artificial Sequence
  chemically synthesized
SQVTPFKFPIEELEDRVFVNCNTSIYRASSLSNCRHTSSVEE

SEQ ID NO: 500 - protein, 42 aa, Artificial Sequence
  chemically synthesized
SQVTPFKMPIEELEDRVFVNCNTSIYRASSLSNCRHTSSVEE

SEQ ID NO: 501 - protein, 42 aa, Artificial Sequence
  chemically synthesized
SQVTPFKIPLEELEDRVFVNCNTSIYRASSLSNCRHTSSVEE

SEQ ID NO: 502 - protein, 42 aa, Artificial Sequence
  chemically synthesized
SQVTPFKIPHEELEDRVFVNCNTSIYRASSLSNCRHTSSVEE

SEQ ID NO: 503 - protein, 42 aa, Artificial Sequence
  chemically synthesized
SQVTPFKIPVEELEDRVFVNCNTSIYRASSLSNCRHTSSVEE

SEQ ID NO: 504 - protein, 42 aa, Artificial Sequence
  chemically synthesized
SQVTPFKIPFEELEDRVFVNCNTSIYRASSLSNCRHTSSVEE

SEQ ID NO: 505 - protein, 42 aa, Artificial Sequence
  chemically synthesized
SQVTPFKIPMEELEDRVFVNCNTSIYRASSLSNCRHTSSVEE

SEQ ID NO: 506 - protein, 42 aa, Artificial Sequence
  chemically synthesized
SQVTPFKIPIDELEDRVFVNCNTSIYRASSLSNCRHTSSVEE

SEQ ID NO: 507 - protein, 42 aa, Artificial Sequence
  chemically synthesized
  misc_feature (11)..(11): Xaa can be a proteinogenic, non-proteinogenic or synthetic amino acid like ornithin or selenocystein
SQVTPFKIPIXELEDRVFVNCNTSIYRASSLSNCRHTSSVEE

SEQ ID NO: 508 - protein, 42 aa, Artificial Sequence
  chemically synthesized
SQVTPFKIPIEDLEDRVFVNCNTSIYRASSLSNCRHTSSVEE

SEQ ID NO: 509 - protein, 42 aa, Artificial Sequence
  chemically synthesized
  misc_feature (12)..(12): Xaa can be a proteinogenic, non-proteinogenic or synthetic amino acid like ornithin or selenocystein
SQVTPFKIPIEXLEDRVFVNCNTSIYRASSLSNCRHTSSVEE

SEQ ID NO: 510 - protein, 42 aa, Artificial Sequence
  chemically synthesized
SQVTPFKIPIEEVEDRVFVNCNTSIYRASSLSNCRHTSSVEE

SEQ ID NO: 511 - protein, 42 aa, Artificial Sequence
  chemically synthesized
SQVTPFKIPIEEIEDRVFVNCNTSIYRASSLSNCRHTSSVEE

SEQ ID NO: 512 - protein, 42 aa, Artificial Sequence
  chemically synthesized
SQVTPFKIPIEEFEDRVFVNCNTSIYRASSLSNCRHTSSVEE

SEQ ID NO: 513 - protein, 42 aa, Artificial Sequence
  chemically synthesized
SQVTPFKIPIEEHEDRVFVNCNTSIYRASSLSNCRHTSSVEE

SEQ ID NO: 514 - protein, 42 aa, Artificial Sequence
  chemically synthesized
SQVTPFKIPIEEMEDRVFVNCNTSIYRASSLSNCRHTSSVEE

SEQ ID NO: 515 - protein, 42 aa, Artificial Sequence
  chemically synthesized
SQVTPFKIPIEELDDRVFVNCNTSIYRASSLSNCRHTSSVEE

SEQ ID NO: 516 - protein, 42 aa, Artificial Sequence
  chemically synthesized
  misc_feature (14)..(14): Xaa can be a proteinogenic, non-proteinogenic or synthetic amino acid like ornithin or selenocystein
SQVTPFKIPIEELXDRVFVNCNTSIYRASSLSNCRHTSSVEE

SEQ ID NO: 517 - protein, 42 aa, Artificial Sequence
  chemically synthesized
  misc_feature (15)..(15): Xaa can be a proteinogenic, non-proteinogenic or synthetic amino acid like ornithin or selenocystein
SQVTPFKIPIEELEXRVFVNCNTSIYRASSLSNCRHTSSVEE

SEQ ID NO: 518 - protein, 42 aa, Artificial Sequence
  chemically synthesized
SQVTPFKIPIEELEERVFVNCNTSIYRASSLSNCRHTSSVEE

SEQ ID NO: 519 - protein, 42 aa, Artificial Sequence
  chemically synthesized
SQVTPFKIPIEELEDKVFVNCNTSIYRASSLSNCRHTSSVEE

SEQ ID NO: 520 - protein, 42 aa, Artificial Sequence
  chemically synthesized
SQVTPFKIPIEELEDHVFVNCNTSIYRASSLSNCRHTSSVEE

SEQ ID NO: 521 - protein, 42 aa, Artificial Sequence
  chemically synthesized
  misc_feature (16)..(16): Xaa can be a proteinogenic, non-proteinogenic or synthetic amino acid like ornithin or selenocystein
SQVTPFKIPIEELEDXVFVNCNTSIYRASSLSNCRHTSSVEE

SEQ ID NO: 522 - protein, 42 aa, Artificial Sequence
  chemically synthesized
SQVTPFKIPIEELEDRIFVNCNTSIYRASSLSNCRHTSSVEE

SEQ ID NO: 523 - protein, 42 aa, Artificial Sequence
  chemically synthesized
SQVTPFKIPIEELEDRLFVNCNTSIYRASSLSNCRHTSSVEE

SEQ ID NO: 524 - protein, 42 aa, Artificial Sequence
  chemically synthesized
SQVTPFKIPIEELEDRFFVNCNTSIYRASSLSNCRHTSSVEE

SEQ ID NO: 525 - protein, 42 aa, Artificial Sequence
  chemically synthesized
SQVTPFKIPIEELEDRHFVNCNTSIYRASSLSNCRHTSSVEE

SEQ ID NO: 526 - protein, 42 aa, Artificial Sequence
  chemically synthesized
SQVTPFKIPIEELEDRMFVNCNTSIYRASSLSNCRHTSSVEE

SEQ ID NO: 527 - protein, 42 aa, Artificial Sequence
  chemically synthesized
SQVTPFKIPIEELEDRVIVNCNTSIYRASSLSNCRHTSSVEE

SEQ ID NO: 528 - protein, 42 aa, Artificial Sequence
  chemically synthesized
SQVTPFKIPIEELEDRVLVNCNTSIYRASSLSNCRHTSSVEE

SEQ ID NO: 529 - protein, 42 aa, Artificial Sequence
  chemically synthesized
SQVTPFKIPIEELEDRVVVNCNTSIYRASSLSNCRHTSSVEE

SEQ ID NO: 530 - protein, 42 aa, Artificial Sequence
  chemically synthesized
SQVTPFKIPIEELEDRVHVNCNTSIYRASSLSNCRHTSSVEE

SEQ ID NO: 531 - protein, 42 aa, Artificial Sequence
  chemically synthesized
SQVTPFKIPIEELEDRVMVNCNTSIYRASSLSNCRHTSSVEE

SEQ ID NO: 532 - protein, 42 aa, Artificial Sequence
  chemically synthesized
SQVTPFKIPIEELEDRVFINCNTSIYRASSLSNCRHTSSVEE

SEQ ID NO: 533 - protein, 42 aa, Artificial Sequence
  chemically synthesized
SQVTPFKIPIEELEDRVFLNCNTSIYRASSLSNCRHTSSVEE

SEQ ID NO: 534 - protein, 42 aa, Artificial Sequence
  chemically synthesized
SQVTPFKIPIEELEDRVFFNCNTSIYRASSLSNCRHTSSVEE

SEQ ID NO: 535 - protein, 42 aa, Artificial Sequence
  chemically synthesized
SQVTPFKIPIEELEDRVFHNCNTSIYRASSLSNCRHTSSVEE

SEQ ID NO: 536 - protein, 42 aa, Artificial Sequence
  chemically synthesized
SQVTPFKIPIEELEDRVFMNCNTSIYRASSLSNCRHTSSVEE

SEQ ID NO: 537 - protein, 42 aa, Artificial Sequence
  chemically synthesized
SQVTPFKIPIEELEDRVFVQCNTSIYRASSLSNCRHTSSVEE

SEQ ID NO: 538 - protein, 42 aa, Artificial Sequence
  chemically synthesized
SQVTPFKIPIEELEDRVFVNSNTSIYRASSLSNCRHTSSVEE

SEQ ID NO: 539 - protein, 42 aa, Artificial Sequence
  chemically synthesized
SQVTPFKIPIEELEDRVFVNGNTSIYRASSLSNCRHTSSVEE

SEQ ID NO: 540 - protein, 42 aa, Artificial Sequence
  chemically synthesized
SQVTPFKIPIEELEDRVFVNANTSIYRASSLSNCRHTSSVEE

SEQ ID NO: 541 - protein, 42 aa, Artificial Sequence
  chemically synthesized
SQVTPFKIPIEELEDRVFVNCQTSIYRASSLSNCRHTSSVEE

SEQ ID NO: 542 - protein, 42 aa, Artificial Sequence
  chemically synthesized
SQVTPFKIPIEELEDRVFVNCNSSIYRASSLSNCRHTSSVEE

SEQ ID NO: 543 - protein, 42 aa, Artificial Sequence
  chemically synthesized
SQVTPFKIPIEELEDRVFVNCNYSIYRASSLSNCRHTSSVEE

SEQ ID NO: 544 - protein, 42 aa, Artificial Sequence
  chemically synthesized
SQVTPFKIPIEELEDRVFVNCNTTIYRASSLSNCRHTSSVEE

SEQ ID NO: 545 - protein, 42 aa, Artificial Sequence
  chemically synthesized
SQVTPFKIPIEELEDRVFVNCNTYIYRASSLSNCRHTSSVEE

SEQ ID NO: 546 - protein, 42 aa, Artificial Sequence
  chemically synthesized
SQVTPFKIPIEELEDRVFVNCNTSVYRASSLSNCRHTSSVEE

SEQ ID NO: 547 - protein, 42 aa, Artificial Sequence
  chemically synthesized
SQVTPFKIPIEELEDRVFVNCNTSLYRASSLSNCRHTSSVEE

SEQ ID NO: 548 - protein, 42 aa, Artificial Sequence
  chemically synthesized
SQVTPFKIPIEELEDRVFVNCNTSHYRASSLSNCRHTSSVEE

SEQ ID NO: 549 - protein, 42 aa, Artificial Sequence
  chemically synthesized
SQVTPFKIPIEELEDRVFVNCNTSFYRASSLSNCRHTSSVEE

SEQ ID NO: 550 - protein, 42 aa, Artificial Sequence
  chemically synthesized
SQVTPFKIPIEELEDRVFVNCNTSMYRASSLSNCRHTSSVEE

SEQ ID NO: 551 - protein, 42 aa, Artificial Sequence
  chemically synthesized
SQVTPFKIPIEELEDRVFVNCNTSIWRASSLSNCRHTSSVEE

SEQ ID NO: 552 - protein, 42 aa, Artificial Sequence
  chemically synthesized
SQVTPFKIPIEELEDRVFVNCNTSIFRASSLSNCRHTSSVEE

SEQ ID NO: 553 - protein, 42 aa, Artificial Sequence
  chemically synthesized
SQVTPFKIPIEELEDRVFVNCNTSISRASSLSNCRHTSSVEE

SEQ ID NO: 554 - protein, 42 aa, Artificial Sequence
  chemically synthesized
SQVTPFKIPIEELEDRVFVNCNTSITRASSLSNCRHTSSVEE

SEQ ID NO: 555 - protein, 42 aa, Artificial Sequence
  chemically synthesized
  misc_feature (27)..(27): Xaa can be a proteinogenic, non-proteinogenic or synthetic amino acid like ornithin or selenocystein
SQVTPFKIPIEELEDRVFVNCNTSIYXASSLSNCRHTSSVEE

SEQ ID NO: 556 - protein, 42 aa, Artificial Sequence
  chemically synthesized
SQVTPFKIPIEELEDRVFVNCNTSIYHASSLSNCRHTSSVEE

SEQ ID NO: 557 - protein, 42 aa, Artificial Sequence
  chemically synthesized
SQVTPFKIPIEELEDRVFVNCNTSIYKASSLSNCRHTSSVEE

SEQ ID NO: 558 - protein, 42 aa, Artificial Sequence
  chemically synthesized
SQVTPFKIPIEELEDRVFVNCNTSIYRGSSLSNCRHTSSVEE

SEQ ID NO: 559 - protein, 42 aa, Artificial Sequence
  chemically synthesized
SQVTPFKIPIEELEDRVFVNCNTSIYRATSLSNCRHTSSVEE

SEQ ID NO: 560 - protein, 42 aa, Artificial Sequence
  chemically synthesized
SQVTPFKIPIEELEDRVFVNCNTSIYRAYSLSNCRHTSSVEE

SEQ ID NO: 561 - protein, 42 aa, Artificial Sequence
  chemically synthesized
SQVTPFKIPIEELEDRVFVNCNTSIYRASTLSNCRHTSSVEE

SEQ ID NO: 562 - protein, 42 aa, Artificial Sequence
  chemically synthesized
SQVTPFKIPIEELEDRVFVNCNTSIYRASYLSNCRHTSSVEE

SEQ ID NO: 563 - protein, 42 aa, Artificial Sequence
  chemically synthesized
SQVTPFKIPIEELEDRVFVNCNTSIYRASSISNCRHTSSVEE

SEQ ID NO: 564 - protein, 42 aa, Artificial Sequence
  chemically synthesized
SQVTPFKIPIEELEDRVFVNCNTSIYRASSVSNCRHTSSVEE

SEQ ID NO: 565 - protein, 42 aa, Artificial Sequence
  chemically synthesized
SQVTPFKIPIEELEDRVFVNCNTSIYRASSFSNCRHTSSVEE

SEQ ID NO: 566 - protein, 42 aa, Artificial Sequence
  chemically synthesized
SQVTPFKIPIEELEDRVFVNCNTSIYRASSMSNCRHTSSVEE

SEQ ID NO: 567 - protein, 42 aa, Artificial Sequence
  chemically synthesized
SQVTPFKIPIEELEDRVFVNCNTSIYRASSHSNCRHTSSVEE

SEQ ID NO: 568 - protein, 42 aa, Artificial Sequence
  chemically synthesized
SQVTPFKIPIEELEDRVFVNCNTSIYRASSLTNCRHTSSVEE

SEQ ID NO: 569 - protein, 42 aa, Artificial Sequence
  chemically synthesized
SQVTPFKIPIEELEDRVFVNCNTSIYRASSLYNCRHTSSVEE

SEQ ID NO: 570 - protein, 42 aa, Artificial Sequence
  chemically synthesized
SQVTPFKIPIEELEDRVFVNCNTSIYRASSLSQCRHTSSVEE

SEQ ID NO: 571 - protein, 42 aa, Artificial Sequence
  chemically synthesized
SQVTPFKIPIEELEDRVFVNCNTSIYRASSLSNSRHTSSVEE

SEQ ID NO: 572 - protein, 42 aa, Artificial Sequence
  chemically synthesized
SQVTPFKIPIEELEDRVFVNCNTSIYRASSLSNGRHTSSVEE

SEQ ID NO: 573 - protein, 42 aa, Artificial Sequence
  chemically synthesized
SQVTPFKIPIEELEDRVFVNCNTSIYRASSLSNARHTSSVEE

SEQ ID NO: 574 - protein, 42 aa, Artificial Sequence
  chemically synthesized
  misc_feature (35)..(35): Xaa can be a proteinogenic, non-proteinogenic or synthetic amino acid like ornithin or selenocystein
SQVTPFKIPIEELEDRVFVNCNTSIYRASSLSNCXHTSSVEE

SEQ ID NO: 575 - protein, 42 aa, Artificial Sequence
  chemically synthesized
SQVTPFKIPIEELEDRVFVNCNTSIYRASSLSNCHHTSSVEE

SEQ ID NO: 576 - protein, 42 aa, Artificial Sequence
  chemically synthesized
SQVTPFKIPIEELEDRVFVNCNTSIYRASSLSNCKHTSSVEE

SEQ ID NO: 577 - protein, 42 aa, Artificial Sequence
  chemically synthesized
SQVTPFKIPIEELEDRVFVNCNTSIYRASSLSNCRGTSSVEE

SEQ ID NO: 578 - protein, 42 aa, Artificial Sequence
  chemically synthesized
SQVTPFKIPIEELEDRVFVNCNTSIYRASSLSNCRATSSVEE

SEQ ID NO: 579 - protein, 42 aa, Artificial Sequence
  chemically synthesized
SQVTPFKIPIEELEDRVFVNCNTSIYRASSLSNCRITSSVEE

SEQ ID NO: 580 - protein, 42 aa, Artificial Sequence
  chemically synthesized
SQVTPFKIPIEELEDRVFVNCNTSIYRASSLSNCRLTSSVEE

SEQ ID NO: 581 - protein, 42 aa, Artificial Sequence
  chemically synthesized
SQVTPFKIPIEELEDRVFVNCNTSIYRASSLSNCRMTSSVEE

SEQ ID NO: 582 - protein, 42 aa, Artificial Sequence
  chemically synthesized
SQVTPFKIPIEELEDRVFVNCNTSIYRASSLSNCRVTSSVEE

SEQ ID NO: 583 - protein, 42 aa, Artificial Sequence
  chemically synthesized
SQVTPFKIPIEELEDRVFVNCNTSIYRASSLSNCRHSSSVEE

SEQ ID NO: 584 - protein, 42 aa, Artificial Sequence
  chemically synthesized
SQVTPFKIPIEELEDRVFVNCNTSIYRASSLSNCRHYSSVEE

SEQ ID NO: 585 - protein, 42 aa, Artificial Sequence
  chemically synthesized
SQVTPFKIPIEELEDRVFVNCNTSIYRASSLSNCRHTTSVEE

SEQ ID NO: 586 - protein, 42 aa, Artificial Sequence
  chemically synthesized
SQVTPFKIPIEELEDRVFVNCNTSIYRASSLSNCRHTYSVEE

SEQ ID NO: 587 - protein, 42 aa, Artificial Sequence
  chemically synthesized
SQVTPFKIPIEELEDRVFVNCNTSIYRASSLSNCRHTSTVEE

SEQ ID NO: 588 - protein, 42 aa, Artificial Sequence
  chemically synthesized
SQVTPFKIPIEELEDRVFVNCNTSIYRASSLSNCRHTSYVEE

SEQ ID NO: 589 - protein, 42 aa, Artificial Sequence
  chemically synthesized
SQVTPFKIPIEELEDRVFVNCNTSIYRASSLSNCRHTSSIEE

SEQ ID NO: 590 - protein, 42 aa, Artificial Sequence
  chemically synthesized
SQVTPFKIPIEELEDRVFVNCNTSIYRASSLSNCRHTSSLEE

SEQ ID NO: 591 - protein, 42 aa, Artificial Sequence
  chemically synthesized
SQVTPFKIPIEELEDRVFVNCNTSIYRASSLSNCRHTSSFEE

SEQ ID NO: 592 - protein, 42 aa, Artificial Sequence
  chemically synthesized
SQVTPFKIPIEELEDRVFVNCNTSIYRASSLSNCRHTSSHEE

SEQ ID NO: 593 - protein, 42 aa, Artificial Sequence
  chemically synthesized
SQVTPFKIPIEELEDRVFVNCNTSIYRASSLSNCRHTSSMEE

SEQ ID NO: 594 - protein, 42 aa, Artificial Sequence
  chemically synthesized
SQVTPFKIPIEELEDRVFVNCNTSIYRASSLSNCRHTSSVDE

SEQ ID NO: 595 - protein, 42 aa, Artificial Sequence
  chemically synthesized
  misc_feature (41)..(41): Xaa can be a proteinogenic, non-proteinogenic or synthetic amino acid like ornithin or selenocystein
SQVTPFKIPIEELEDRVFVNCNTSIYRASSLSNCRHTSSVXE

SEQ ID NO: 596 - protein, 42 aa, Artificial Sequence
  chemically synthesized
SQVTPFKIPIEELEDRVFVNCNTSIYRASSLSNCRHTSSVED

SEQ ID NO: 597 - protein, 42 aa, Artificial Sequence
  chemically synthesized
  misc_feature (42)..(42): Xaa can be a proteinogenic, non-proteinogenic or synthetic amino acid like ornithin or selenocystein
SQVTPFKIPIEELEDRVFVNCNTSIYRASSLSNCRHTSSVEX

SEQ ID NO: 598 - protein, 42 aa, Artificial Sequence
  chemically synthesized
SQVTAFKIPIEELEDRVFVNCNTSIYRASSLSNCRHTSSVEE

SEQ ID NO: 599 - protein, 42 aa, Artificial Sequence
  chemically synthesized
SQVTGFKIPIEELEDRVFVNCNTSIYRASSLSNCRHTSSVEE

SEQ ID NO: 600 - protein, 42 aa, Artificial Sequence
  chemically synthesized
SQVTPFKIAIEELEDRVFVNCNTSIYRASSLSNCRHTSSVEE

SEQ ID NO: 601 - protein, 42 aa, Artificial Sequence
  chemically synthesized
SQVTPFKIGIEELEDRVFVNCNTSIYRASSLSNCRHTSSVEE

SEQ ID NO: 602 - protein, 42 aa, Artificial Sequence; identical to SEQ ID NO: 17
  chemically synthesized

SEQ ID NO: 603 - protein, 42 aa, Artificial Sequence; identical to SEQ ID NO: 136
  chemically synthesized

SEQ ID NO: 604 - protein, 42 aa, Artificial Sequence
  chemically synthesized
YQVSPFRIPIEELEDRVFVNCNTSIYRASSLSNCRHTSSVEE

SEQ ID NO: 605 - protein, 42 aa, Artificial Sequence; identical to SEQ ID NO: 256
  chemically synthesized

SEQ ID NO: 606 - protein, 42 aa, Artificial Sequence; identical to SEQ ID NO: 374
  chemically synthesized

SEQ ID NO: 607 - protein, 42 aa, Artificial Sequence
  chemically synthesized
SQISPFRIPIEELEDRVFVNCNTSIYRASSLSNCRHTSSVEE

SEQ ID NO: 608 - protein, 42 aa, Artificial Sequence
  chemically synthesized
SQPSPFRIPIEELEDRVFVNCNTSIYRASSLSNCRHTSSVEE

SEQ ID NO: 609 - protein, 42 aa, Artificial Sequence
  chemically synthesized
SQFSPFRIPIEELEDRVFVNCNTSIYRASSLSNCRHTSSVEE

SEQ ID NO: 610 - protein, 42 aa, Artificial Sequence; identical to SEQ ID NO: 493
  chemically synthesized

SEQ ID NO: 611 - protein, 42 aa, Artificial Sequence
  chemically synthesized
SQVYPFRIPIEELEDRVFVNCNTSIYRASSLSNCRHTSSVEE

SEQ ID NO: 612 - protein, 42 aa, Artificial Sequence
  chemically synthesized
SQVSPWRIPIEELEDRVFVNCNTSIYRASSLSNCRHTSSVEE

SEQ ID NO: 613 - protein, 42 aa, Artificial Sequence
  chemically synthesized
SQVSPYRIPIEELEDRVFVNCNTSIYRASSLSNCRHTSSVEE

SEQ ID NO: 614 - protein, 42 aa, Artificial Sequence
  chemically synthesized
SQVSPHRIPIEELEDRVFVNCNTSIYRASSLSNCRHTSSVEE

SEQ ID NO: 615 - protein, 42 aa, Artificial Sequence; identical to SEQ ID NO: 17
  chemically synthesized

SEQ ID NO: 616 - protein, 42 aa, Artificial Sequence; identical to SEQ ID NO: 17
  chemically synthesized

SEQ ID NO: 617 - protein, 42 aa, Artificial Sequence
  chemically synthesized
SQFSPFRLPIEELEDRVFVNCNTSIYRASSLSNCRHTSSVEE

SEQ ID NO: 618 - protein, 42 aa, Artificial Sequence
  chemically synthesized
SQFSPFRHPIEELEDRVFVNCNTSIYRASSLSNCRHTSSVEE

SEQ ID NO: 619 - protein, 42 aa, Artificial Sequence
  chemically synthesized
SQFSPFRVPIEELEDRVFVNCNTSIYRASSLSNCRHTSSVEE

SEQ ID NO: 620 - protein, 42 aa, Artificial Sequence
  chemically synthesized
SQFSPFRFPIEELEDRVFVNCNTSIYRASSLSNCRHTSSVEE

SEQ ID NO: 621 - protein, 42 aa, Artificial Sequence
  chemically synthesized
SQFSPFRMPIEELEDRVFVNCNTSIYRASSLSNCRHTSSVEE

SEQ ID NO: 622 - protein, 42 aa, Artificial Sequence
  chemically synthesized
SQFSPFRIPLEELEDRVFVNCNTSIYRASSLSNCRHTSSVEE

SEQ ID NO: 623 - protein, 42 aa, Artificial Sequence
  chemically synthesized
SQFSPFRIPHEELEDRVFVNCNTSIYRASSLSNCRHTSSVEE

SEQ ID NO: 624 - protein, 42 aa, Artificial Sequence
  chemically synthesized
SQFSPFRIPVEELEDRVFVNCNTSIYRASSLSNCRHTSSVEE

SEQ ID NO: 625 - protein, 42 aa, Artificial Sequence
  chemically synthesized
SQFSPFRIPFEELEDRVFVNCNTSIYRASSLSNCRHTSSVEE

SEQ ID NO: 626 - protein, 42 aa, Artificial Sequence
  chemically synthesized
SQFSPFRIPMEELEDRVFVNCNTSIYRASSLSNCRHTSSVEE

SEQ ID NO: 627 - protein, 42 aa, Artificial Sequence
  chemically synthesized
SQFSPFRIPIDELEDRVFVNCNTSIYRASSLSNCRHTSSVEE

SEQ ID NO: 628 - protein, 42 aa, Artificial Sequence
  chemically synthesized
  misc_feature (11)..(11): Xaa can be a proteinogenic, non-proteinogenic or synthetic amino acid like ornithin or selenocystein
SQFSPFRIPIXELEDRVFVNCNTSIYRASSLSNCRHTSSVEE

SEQ ID NO: 629 - protein, 42 aa, Artificial Sequence
  chemically synthesized
SQFSPFRIPIEDLEDRVFVNCNTSIYRASSLSNCRHTSSVEE

SEQ ID NO: 630 - protein, 42 aa, Artificial Sequence
  chemically synthesized
  misc_feature (12)..(12): Xaa can be a proteinogenic, non-proteinogenic or synthetic amino acid like ornithin or selenocystein
SQFSPFRIPIEXLEDRVFVNCNTSIYRASSLSNCRHTSSVEE

SEQ ID NO: 631 - protein, 42 aa, Artificial Sequence
  chemically synthesized
SQFSPFRIPIEEVEDRVFVNCNTSIYRASSLSNCRHTSSVEE

SEQ ID NO: 632 - protein, 42 aa, Artificial Sequence
  chemically synthesized
SQFSPFRIPIEEIEDRVFVNCNTSIYRASSLSNCRHTSSVEE

SEQ ID NO: 633 - protein, 42 aa, Artificial Sequence
  chemically synthesized
SQFSPFRIPIEEFEDRVFVNCNTSIYRASSLSNCRHTSSVEE

SEQ ID NO: 634 - protein, 42 aa, Artificial Sequence
  chemically synthesized
SQFSPFRIPIEEHEDRVFVNCNTSIYRASSLSNCRHTSSVEE

SEQ ID NO: 635 - protein, 42 aa, Artificial Sequence
  chemically synthesized
SQFSPFRIPIEEMEDRVFVNCNTSIYRASSLSNCRHTSSVEE

SEQ ID NO: 636 - protein, 42 aa, Artificial Sequence
  chemically synthesized
SQFSPFRIPIEELDDRVFVNCNTSIYRASSLSNCRHTSSVEE

SEQ ID NO: 637 - protein, 42 aa, Artificial Sequence
  chemically synthesized
  misc_feature (14)..(14): Xaa can be a proteinogenic, non-proteinogenic or synthetic amino acid like ornithin or selenocystein
SQFSPFRIPIEELXDRVFVNCNTSIYRASSLSNCRHTSSVEE

SEQ ID NO: 638 - protein, 42 aa, Artificial Sequence
  chemically synthesized
  misc_feature (15)..(15): Xaa can be a proteinogenic, non-proteinogenic or synthetic amino acid like ornithin or selenocystein
SQFSPFRIPIEELEXRVFVNCNTSIYRASSLSNCRHTSSVEE

SEQ ID NO: 639 - protein, 42 aa, Artificial Sequence
  chemically synthesized
SQFSPFRIPIEELEERVFVNCNTSIYRASSLSNCRHTSSVEE

SEQ ID NO: 640 - protein, 42 aa, Artificial Sequence
  chemically synthesized
SQFSPFRIPIEELEDKVFVNCNTSIYRASSLSNCRHTSSVEE

SEQ ID NO: 641 - protein, 42 aa, Artificial Sequence
  chemically synthesized
SQFSPFRIPIEELEDHVFVNCNTSIYRASSLSNCRHTSSVEE

SEQ ID NO: 642 - protein, 42 aa, Artificial Sequence
  chemically synthesized
  misc_feature (16)..(16): Xaa can be a proteinogenic, non-proteinogenic or synthetic amino acid like ornithin or selenocystein
SQFSPFRIPIEELEDXVFVNCNTSIYRASSLSNCRHTSSVEE

SEQ ID NO: 643 - protein, 42 aa, Artificial Sequence
  chemically synthesized
SQFSPFRIPIEELEDRIFVNCNTSIYRASSLSNCRHTSSVEE

SEQ ID NO: 644 - protein, 42 aa, Artificial Sequence
  chemically synthesized
SQFSPFRIPIEELEDRLFVNCNTSIYRASSLSNCRHTSSVEE

SEQ ID NO: 645 - protein, 42 aa, Artificial Sequence
  chemically synthesized
SQFSPFRIPIEELEDRFFVNCNTSIYRASSLSNCRHTSSVEE

SEQ ID NO: 646 - protein, 42 aa, Artificial Sequence
  chemically synthesized
SQFSPFRIPIEELEDRHFVNCNTSIYRASSLSNCRHTSSVEE

SEQ ID NO: 647 - protein, 42 aa, Artificial Sequence
  chemically synthesized
SQFSPFRIPIEELEDRMFVNCNTSIYRASSLSNCRHTSSVEE

SEQ ID NO: 648 - protein, 42 aa, Artificial Sequence
  chemically synthesized
SQFSPFRIPIEELEDRVIVNCNTSIYRASSLSNCRHTSSVEE

SEQ ID NO: 649 - protein, 42 aa, Artificial Sequence
  chemically synthesized
SQFSPFRIPIEELEDRVLVNCNTSIYRASSLSNCRHTSSVEE

SEQ ID NO: 650 - protein, 42 aa, Artificial Sequence
  chemically synthesized
SQFSPFRIPIEELEDRVVVNCNTSIYRASSLSNCRHTSSVEE

SEQ ID NO: 651 - protein, 42 aa, Artificial Sequence
  chemically synthesized
SQFSPFRIPIEELEDRVHVNCNTSIYRASSLSNCRHTSSVEE

SEQ ID NO: 652 - protein, 42 aa, Artificial Sequence
  chemically synthesized
SQFSPFRIPIEELEDRVMVNCNTSIYRASSLSNCRHTSSVEE

SEQ ID NO: 653 - protein, 42 aa, Artificial Sequence
  chemically synthesized
SQFSPFRIPIEELEDRVFINCNTSIYRASSLSNCRHTSSVEE

SEQ ID NO: 654 - protein, 42 aa, Artificial Sequence
  chemically synthesized
SQFSPFRIPIEELEDRVFLNCNTSIYRASSLSNCRHTSSVEE

SEQ ID NO: 655 - protein, 42 aa, Artificial Sequence
  chemically synthesized
SQFSPFRIPIEELEDRVFFNCNTSIYRASSLSNCRHTSSVEE

SEQ ID NO: 656 - protein, 42 aa, Artificial Sequence
  chemically synthesized
SQFSPFRIPIEELEDRVFHNCNTSIYRASSLSNCRHTSSVEE

SEQ ID NO: 657 - protein, 42 aa, Artificial Sequence
  chemically synthesized
SQFSPFRIPIEELEDRVFMNCNTSIYRASSLSNCRHTSSVEE

SEQ ID NO: 658 - protein, 42 aa, Artificial Sequence
  chemically synthesized
SQFSPFRIPIEELEDRVFVQCNTSIYRASSLSNCRHTSSVEE

SEQ ID NO: 659 - protein, 42 aa, Artificial Sequence
  chemically synthesized
SQFSPFRIPIEELEDRVFVNSNTSIYRASSLSNCRHTSSVEE

SEQ ID NO: 660 - protein, 42 aa, Artificial Sequence
  chemically synthesized
SQFSPFRIPIEELEDRVFVNGNTSIYRASSLSNCRHTSSVEE

SEQ ID NO: 661 - protein, 42 aa, Artificial Sequence
  chemically synthesized
SQFSPFRIPIEELEDRVFVNANTSIYRASSLSNCRHTSSVEE

SEQ ID NO: 662 - protein, 42 aa, Artificial Sequence
  chemically synthesized
SQFSPFRIPIEELEDRVFVNCQTSIYRASSLSNCRHTSSVEE

SEQ ID NO: 663 - protein, 42 aa, Artificial Sequence
  chemically synthesized
SQFSPFRIPIEELEDRVFVNCNSSIYRASSLSNCRHTSSVEE

SEQ ID NO: 664 - protein, 42 aa, Artificial Sequence
  chemically synthesized
SQFSPFRIPIEELEDRVFVNCNYSIYRASSLSNCRHTSSVEE

SEQ ID NO: 665 - protein, 42 aa, Artificial Sequence
  chemically synthesized
SQFSPFRIPIEELEDRVFVNCNTTIYRASSLSNCRHTSSVEE

SEQ ID NO: 666 - protein, 42 aa, Artificial Sequence
  chemically synthesized
SQFSPFRIPIEELEDRVFVNCNTYIYRASSLSNCRHTSSVEE

SEQ ID NO: 667 - protein, 42 aa, Artificial Sequence
  chemically synthesized
SQFSPFRIPIEELEDRVFVNCNTSVYRASSLSNCRHTSSVEE

SEQ ID NO: 668 - protein, 42 aa, Artificial Sequence
  chemically synthesized
SQFSPFRIPIEELEDRVFVNCNTSLYRASSLSNCRHTSSVEE

SEQ ID NO: 669 - protein, 42 aa, Artificial Sequence
  chemically synthesized
SQFSPFRIPIEELEDRVFVNCNTSHYRASSLSNCRHTSSVEE

SEQ ID NO: 670 - protein, 42 aa, Artificial Sequence
  chemically synthesized
SQFSPFRIPIEELEDRVFVNCNTSFYRASSLSNCRHTSSVEE

SEQ ID NO: 671 - protein, 42 aa, Artificial Sequence
  chemically synthesized
SQFSPFRIPIEELEDRVFVNCNTSMYRASSLSNCRHTSSVEE

SEQ ID NO: 672 - protein, 42 aa, Artificial Sequence
  chemically synthesized
SQFSPFRIPIEELEDRVFVNCNTSIWRASSLSNCRHTSSVEE

SEQ ID NO: 673 - protein, 42 aa, Artificial Sequence
  chemically synthesized
SQFSPFRIPIEELEDRVFVNCNTSIFRASSLSNCRHTSSVEE

SEQ ID NO: 674 - protein, 42 aa, Artificial Sequence
  chemically synthesized
SQFSPFRIPIEELEDRVFVNCNTSISRASSLSNCRHTSSVEE

SEQ ID NO: 675 - protein, 42 aa, Artificial Sequence
  chemically synthesized
SQFSPFRIPIEELEDRVFVNCNTSITRASSLSNCRHTSSVEE

SEQ ID NO: 676 - protein, 42 aa, Artificial Sequence
  chemically synthesized
  misc_feature (27)..(27): Xaa can be a proteinogenic, non-proteinogenic or synthetic amino acid like ornithin or selenocystein
SQFSPFRIPIEELEDRVFVNCNTSIYXASSLSNCRHTSSVEE

SEQ ID NO: 677 - protein, 42 aa, Artificial Sequence
  chemically synthesized
SQFSPFRIPIEELEDRVFVNCNTSIYHASSLSNCRHTSSVEE

SEQ ID NO: 678 - protein, 42 aa, Artificial Sequence
  chemically synthesized
SQFSPFRIPIEELEDRVFVNCNTSIYKASSLSNCRHTSSVEE

SEQ ID NO: 679 - protein, 42 aa, Artificial Sequence
  chemically synthesized
SQFSPFRIPIEELEDRVFVNCNTSIYRGSSLSNCRHTSSVEE

SEQ ID NO: 680 - protein, 42 aa, Artificial Sequence
  chemically synthesized
SQFSPFRIPIEELEDRVFVNCNTSIYRATSLSNCRHTSSVEE

SEQ ID NO: 681 - protein, 42 aa, Artificial Sequence
  chemically synthesized
SQFSPFRIPIEELEDRVFVNCNTSIYRAYSLSNCRHTSSVEE

SEQ ID NO: 682 - protein, 42 aa, Artificial Sequence
  chemically synthesized
SQFSPFRIPIEELEDRVFVNCNTSIYRASTLSNCRHTSSVEE

SEQ ID NO: 683 - protein, 42 aa, Artificial Sequence
  chemically synthesized
SQFSPFRIPIEELEDRVFVNCNTSIYRASYLSNCRHTSSVEE

SEQ ID NO: 684 - protein, 42 aa, Artificial Sequence
  chemically synthesized
SQFSPFRIPIEELEDRVFVNCNTSIYRASSISNCRHTSSVEE

SEQ ID NO: 685 - protein, 42 aa, Artificial Sequence
  chemically synthesized
SQFSPFRIPIEELEDRVFVNCNTSIYRASSVSNCRHTSSVEE

SEQ ID NO: 686 - protein, 42 aa, Artificial Sequence
  chemically synthesized
SQFSPFRIPIEELEDRVFVNCNTSIYRASSFSNCRHTSSVEE

SEQ ID NO: 687 - protein, 42 aa, Artificial Sequence
  chemically synthesized
SQFSPFRIPIEELEDRVFVNCNTSIYRASSMSNCRHTSSVEE

SEQ ID NO: 688 - protein, 42 aa, Artificial Sequence
  chemically synthesized
SQFSPFRIPIEELEDRVFVNCNTSIYRASSHSNCRHTSSVEE

SEQ ID NO: 689 - protein, 42 aa, Artificial Sequence
  chemically synthesized
SQFSPFRIPIEELEDRVFVNCNTSIYRASSLTNCRHTSSVEE

SEQ ID NO: 690 - protein, 42 aa, Artificial Sequence
  chemically synthesized
SQFSPFRIPIEELEDRVFVNCNTSIYRASSLYNCRHTSSVEE

SEQ ID NO: 691 - protein, 42 aa, Artificial Sequence
  chemically synthesized
SQFSPFRIPIEELEDRVFVNCNTSIYRASSLSQCRHTSSVEE

SEQ ID NO: 692 - protein, 42 aa, Artificial Sequence
  chemically synthesized
SQFSPFRIPIEELEDRVFVNCNTSIYRASSLSNSRHTSSVEE

SEQ ID NO: 693 - protein, 42 aa, Artificial Sequence
  chemically synthesized
SQFSPFRIPIEELEDRVFVNCNTSIYRASSLSNGRHTSSVEE

SEQ ID NO: 694 - protein, 42 aa, Artificial Sequence
  chemically synthesized
SQFSPFRIPIEELEDRVFVNCNTSIYRASSLSNARHTSSVEE

SEQ ID NO: 695 - protein, 42 aa, Artificial Sequence
  chemically synthesized
  misc_feature (35)..(35): Xaa can be a proteinogenic, non-proteinogenic or synthetic amino acid like ornithin or selenocystein
SQFSPFRIPIEELEDRVFVNCNTSIYRASSLSNCXHTSSVEE

SEQ ID NO: 696 - protein, 42 aa, Artificial Sequence
  chemically synthesized
SQFSPFRIPIEELEDRVFVNCNTSIYRASSLSNCHHTSSVEE

SEQ ID NO: 697 - protein, 42 aa, Artificial Sequence
  chemically synthesized
SQFSPFRIPIEELEDRVFVNCNTSIYRASSLSNCKHTSSVEE

SEQ ID NO: 698 - protein, 42 aa, Artificial Sequence
  chemically synthesized
SQFSPFRIPIEELEDRVFVNCNTSIYRASSLSNCRGTSSVEE

SEQ ID NO: 699 - protein, 42 aa, Artificial Sequence
  chemically synthesized
SQFSPFRIPIEELEDRVFVNCNTSIYRASSLSNCRATSSVEE

SEQ ID NO: 700 - protein, 42 aa, Artificial Sequence
  chemically synthesized
SQFSPFRIPIEELEDRVFVNCNTSIYRASSLSNCRITSSVEE

SEQ ID NO: 701 - protein, 42 aa, Artificial Sequence
  chemically synthesized
SQFSPFRIPIEELEDRVFVNCNTSIYRASSLSNCRLTSSVEE

SEQ ID NO: 702 - protein, 42 aa, Artificial Sequence
  chemically synthesized
SQFSPFRIPIEELEDRVFVNCNTSIYRASSLSNCRMTSSVEE

SEQ ID NO: 703 - protein, 42 aa, Artificial Sequence
  chemically synthesized
SQFSPFRIPIEELEDRVFVNCNTSIYRASSLSNCRVTSSVEE

SEQ ID NO: 704 - protein, 42 aa, Artificial Sequence
  chemically synthesized
SQFSPFRIPIEELEDRVFVNCNTSIYRASSLSNCRHSSSVEE

SEQ ID NO: 705 - protein, 42 aa, Artificial Sequence
  chemically synthesized
SQFSPFRIPIEELEDRVFVNCNTSIYRASSLSNCRHYSSVEE

SEQ ID NO: 706 - protein, 42 aa, Artificial Sequence
  chemically synthesized
SQFSPFRIPIEELEDRVFVNCNTSIYRASSLSNCRHTTSVEE

SEQ ID NO: 707 - protein, 42 aa, Artificial Sequence
  chemically synthesized
SQFSPFRIPIEELEDRVFVNCNTSIYRASSLSNCRHTYSVEE

SEQ ID NO: 708 - protein, 42 aa, Artificial Sequence
  chemically synthesized
SQFSPFRIPIEELEDRVFVNCNTSIYRASSLSNCRHTSTVEE

SEQ ID NO: 709 - protein, 42 aa, Artificial Sequence
  chemically synthesized
SQFSPFRIPIEELEDRVFVNCNTSIYRASSLSNCRHTSYVEE

SEQ ID NO: 710 - protein, 42 aa, Artificial Sequence
  chemically synthesized
SQFSPFRIPIEELEDRVFVNCNTSIYRASSLSNCRHTSSIEE

SEQ ID NO: 711 - protein, 42 aa, Artificial Sequence
  chemically synthesized
SQFSPFRIPIEELEDRVFVNCNTSIYRASSLSNCRHTSSLEE

SEQ ID NO: 712 - protein, 42 aa, Artificial Sequence
  chemically synthesized
SQFSPFRIPIEELEDRVFVNCNTSIYRASSLSNCRHTSSFEE

SEQ ID NO: 713 - protein, 42 aa, Artificial Sequence
  chemically synthesized
SQFSPFRIPIEELEDRVFVNCNTSIYRASSLSNCRHTSSHEE

SEQ ID NO: 714 - protein, 42 aa, Artificial Sequence
  chemically synthesized
SQFSPFRIPIEELEDRVFVNCNTSIYRASSLSNCRHTSSMEE

SEQ ID NO: 715 - protein, 42 aa, Artificial Sequence
  chemically synthesized
SQFSPFRIPIEELEDRVFVNCNTSIYRASSLSNCRHTSSVDE

SEQ ID NO: 716 - protein, 42 aa, Artificial Sequence
  chemically synthesized
  misc_feature (41)..(41): Xaa can be a proteinogenic, non-proteinogenic or synthetic amino acid like ornithin or selenocystein
SQFSPFRIPIEELEDRVFVNCNTSIYRASSLSNCRHTSSVXE

SEQ ID NO: 717 - protein, 42 aa, Artificial Sequence
  chemically synthesized
SQFSPFRIPIEELEDRVFVNCNTSIYRASSLSNCRHTSSVED

SEQ ID NO: 718 - protein, 42 aa, Artificial Sequence
  chemically synthesized
  misc_feature (42)..(42): Xaa can be a proteinogenic, non-proteinogenic or synthetic amino acid like ornithin or selenocystein
SQFSPFRIPIEELEDRVFVNCNTSIYRASSLSNCRHTSSVEX

SEQ ID NO: 719 - protein, 42 aa, Artificial Sequence; identical to SEQ ID NO: 122
  chemically synthesized

SEQ ID NO: 720 - protein, 42 aa, Artificial Sequence; identical to SEQ ID NO: 123
  chemically synthesized

SEQ ID NO: 721 - protein, 42 aa, Artificial Sequence
  chemically synthesized
SQFSPFRIAIEELEDRVFVNCNTSIYRASSLSNCRHTSSVEE

SEQ ID NO: 722 - protein, 42 aa, Artificial Sequence
  chemically synthesized
SQFSPFRIGIEELEDRVFVNCNTSIYRASSLSNCRHTSSVEE

SEQ ID NO: 723 - protein, 42 aa, Artificial Sequence; identical to SEQ ID NO: 20
  chemically synthesized

SEQ ID NO: 724 - protein, 42 aa, Artificial Sequence; identical to SEQ ID NO: 139
  chemically synthesized

SEQ ID NO: 725 - protein, 42 aa, Artificial Sequence
  chemically synthesized
YQVSPFKLPIEELEDRVFVNCNTSIYRASSLSNCRHTSSVEE

SEQ ID NO: 726 - protein, 42 aa, Artificial Sequence; identical to SEQ ID NO: 259
  chemically synthesized

SEQ ID NO: 727 - protein, 42 aa, Artificial Sequence; identical to SEQ ID NO: 377
  chemically synthesized

SEQ ID NO: 728 - protein, 42 aa, Artificial Sequence
  chemically synthesized
SQISPFKLPIEELEDRVFVNCNTSIYRASSLSNCRHTSSVEE

SEQ ID NO: 729 - protein, 42 aa, Artificial Sequence
  chemically synthesized
SQPSPFKLPIEELEDRVFVNCNTSIYRASSLSNCRHTSSVEE

SEQ ID NO: 730 - protein, 42 aa, Artificial Sequence
  chemically synthesized
SQFSPFKLPIEELEDRVFVNCNTSIYRASSLSNCRHTSSVEE

SEQ ID NO: 731 - protein, 42 aa, Artificial Sequence; identical to SEQ ID NO: 496
  chemically synthesized

SEQ ID NO: 732 - protein, 42 aa, Artificial Sequence
  chemically synthesized
SQVYPFKLPIEELEDRVFVNCNTSIYRASSLSNCRHTSSVEE

SEQ ID NO: 733 - protein, 42 aa, Artificial Sequence
  chemically synthesized
SQVSPWKLPIEELEDRVFVNCNTSIYRASSLSNCRHTSSVEE

SEQ ID NO: 734 - protein, 42 aa, Artificial Sequence
  chemically synthesized
SQVSPYKLPIEELEDRVFVNCNTSIYRASSLSNCRHTSSVEE

SEQ ID NO: 735 - protein, 42 aa, Artificial Sequence
  chemically synthesized
SQVSPHKLPIEELEDRVFVNCNTSIYRASSLSNCRHTSSVEE

SEQ ID NO: 736 - protein, 42 aa, Artificial Sequence
  chemically synthesized
SQVSPFRLPIEELEDRVFVNCNTSIYRASSLSNCRHTSSVEE

SEQ ID NO: 737 - protein, 42 aa, Artificial Sequence
  chemically synthesized
SQVSPFHLPIEELEDRVFVNCNTSIYRASSLSNCRHTSSVEE

SEQ ID NO: 738 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXLPIEELEDRVFVNCNTSIYRASSLSNCRHTSSVEE

SEQ ID NO: 739 - protein, 42 aa, Artificial Sequence; identical to SEQ ID NO: 20
  chemically synthesized

SEQ ID NO: 740 - protein, 42 aa, Artificial Sequence
  chemically synthesized
SQVSPFKLPLEELEDRVFVNCNTSIYRASSLSNCRHTSSVEE

SEQ ID NO: 741 - protein, 42 aa, Artificial Sequence
  chemically synthesized
SQVSPFKLPHEELEDRVFVNCNTSIYRASSLSNCRHTSSVEE

SEQ ID NO: 742 - protein, 42 aa, Artificial Sequence
  chemically synthesized
SQVSPFKLPVEELEDRVFVNCNTSIYRASSLSNCRHTSSVEE

SEQ ID NO: 743 - protein, 42 aa, Artificial Sequence
  chemically synthesized
SQVSPFKLPFEELEDRVFVNCNTSIYRASSLSNCRHTSSVEE

SEQ ID NO: 744 - protein, 42 aa, Artificial Sequence
  chemically synthesized
SQVSPFKLPMEELEDRVFVNCNTSIYRASSLSNCRHTSSVEE

SEQ ID NO: 745 - protein, 42 aa, Artificial Sequence
  chemically synthesized
SQVSPFKLPIDELEDRVFVNCNTSIYRASSLSNCRHTSSVEE

SEQ ID NO: 746 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKLPIXELEDRVFVNCNTSIYRASSLSNCRHTSSVEE

SEQ ID NO: 747 - protein, 42 aa, Artificial Sequence
  chemically synthesized
SQVSPFKLPIEDLEDRVFVNCNTSIYRASSLSNCRHTSSVEE

SEQ ID NO: 748 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKLPIEXLEDRVFVNCNTSIYRASSLSNCRHTSSVEE

SEQ ID NO: 749 - protein, 42 aa, Artificial Sequence
  chemically synthesized
SQVSPFKLPIEEVEDRVFVNCNTSIYRASSLSNCRHTSSVEE

SEQ ID NO: 750 - protein, 42 aa, Artificial Sequence
  chemically synthesized
SQVSPFKLPIEEIEDRVFVNCNTSIYRASSLSNCRHTSSVEE

SEQ ID NO: 751 - protein, 42 aa, Artificial Sequence
  chemically synthesized
SQVSPFKLPIEEFEDRVFVNCNTSIYRASSLSNCRHTSSVEE

SEQ ID NO: 752 - protein, 42 aa, Artificial Sequence
  chemically synthesized
SQVSPFKLPIEEHEDRVFVNCNTSIYRASSLSNCRHTSSVEE

SEQ ID NO: 753 - protein, 42 aa, Artificial Sequence
  chemically synthesized
SQVSPFKLPIEEMEDRVFVNCNTSIYRASSLSNCRHTSSVEE

SEQ ID NO: 754 - protein, 42 aa, Artificial Sequence
  chemically synthesized
SQVSPFKLPIEELDDRVFVNCNTSIYRASSLSNCRHTSSVEE

SEQ ID NO: 755 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKLPIEELXDRVFVNCNTSIYRASSLSNCRHTSSVEE

SEQ ID NO: 756 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKLPIEELEXRVFVNCNTSIYRASSLSNCRHTSSVEE

SEQ ID NO: 757 - protein, 42 aa, Artificial Sequence
  chemically synthesized
SQVSPFKLPIEELEERVFVNCNTSIYRASSLSNCRHTSSVEE

SEQ ID NO: 758 - protein, 42 aa, Artificial Sequence
  chemically synthesized
SQVSPFKLPIEELEDKVFVNCNTSIYRASSLSNCRHTSSVEE

SEQ ID NO: 759 - protein, 42 aa, Artificial Sequence
  chemically synthesized
SQVSPFKLPIEELEDHVFVNCNTSIYRASSLSNCRHTSSVEE

SEQ ID NO: 760 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKLPIEELEDXVFVNCNTSIYRASSLSNCRHTSSVEE

SEQ ID NO: 761 - protein, 42 aa, Artificial Sequence
  chemically synthesized
SQVSPFKLPIEELEDRIFVNCNTSIYRASSLSNCRHTSSVEE

SEQ ID NO: 762 - protein, 42 aa, Artificial Sequence
  chemically synthesized
SQVSPFKLPIEELEDRLFVNCNTSIYRASSLSNCRHTSSVEE

SEQ ID NO: 763 - protein, 42 aa, Artificial Sequence
  chemically synthesized
SQVSPFKLPIEELEDRFFVNCNTSIYRASSLSNCRHTSSVEE

SEQ ID NO: 764 - protein, 42 aa, Artificial Sequence
  chemically synthesized
SQVSPFKLPIEELEDRHFVNCNTSIYRASSLSNCRHTSSVEE

SEQ ID NO: 765 - protein, 42 aa, Artificial Sequence
  chemically synthesized
SQVSPFKLPIEELEDRMFVNCNTSIYRASSLSNCRHTSSVEE

SEQ ID NO: 766 - protein, 42 aa, Artificial Sequence
  chemically synthesized
SQVSPFKLPIEELEDRVIVNCNTSIYRASSLSNCRHTSSVEE

SEQ ID NO: 767 - protein, 42 aa, Artificial Sequence
  chemically synthesized
SQVSPFKLPIEELEDRVLVNCNTSIYRASSLSNCRHTSSVEE

SEQ ID NO: 768 - protein, 42 aa, Artificial Sequence
  chemically synthesized
SQVSPFKLPIEELEDRVVVNCNTSIYRASSLSNCRHTSSVEE

SEQ ID NO: 769 - protein, 42 aa, Artificial Sequence
  chemically synthesized
SQVSPFKLPIEELEDRVHVNCNTSIYRASSLSNCRHTSSVEE

SEQ ID NO: 770 - protein, 42 aa, Artificial Sequence
  chemically synthesized
SQVSPFKLPIEELEDRVMVNCNTSIYRASSLSNCRHTSSVEE

SEQ ID NO: 771 - protein, 42 aa, Artificial Sequence
  chemically synthesized
SQVSPFKLPIEELEDRVFINCNTSIYRASSLSNCRHTSSVEE

SEQ ID NO: 772 - protein, 42 aa, Artificial Sequence
  chemically synthesized
SQVSPFKLPIEELEDRVFLNCNTSIYRASSLSNCRHTSSVEE

SEQ ID NO: 773 - protein, 42 aa, Artificial Sequence
  chemically synthesized
SQVSPFKLPIEELEDRVFFNCNTSIYRASSLSNCRHTSSVEE

SEQ ID NO: 774 - protein, 42 aa, Artificial Sequence
  chemically synthesized
SQVSPFKLPIEELEDRVFHNCNTSIYRASSLSNCRHTSSVEE

SEQ ID NO: 775 - protein, 42 aa, Artificial Sequence
  chemically synthesized
SQVSPFKLPIEELEDRVFMNCNTSIYRASSLSNCRHTSSVEE

SEQ ID NO: 776 - protein, 42 aa, Artificial Sequence
  chemically synthesized
SQVSPFKLPIEELEDRVFVQCNTSIYRASSLSNCRHTSSVEE

SEQ ID NO: 777 - protein, 42 aa, Artificial Sequence
  chemically synthesized
SQVSPFKLPIEELEDRVFVNSNTSIYRASSLSNCRHTSSVEE

SEQ ID NO: 778 - protein, 42 aa, Artificial Sequence
  chemically synthesized
SQVSPFKLPIEELEDRVFVNGNTSIYRASSLSNCRHTSSVEE

SEQ ID NO: 779 - protein, 42 aa, Artificial Sequence
  chemically synthesized
SQVSPFKLPIEELEDRVFVNANTSIYRASSLSNCRHTSSVEE

SEQ ID NO: 780 - protein, 42 aa, Artificial Sequence
  chemically synthesized
SQVSPFKLPIEELEDRVFVNCQTSIYRASSLSNCRHTSSVEE

SEQ ID NO: 781 - protein, 42 aa, Artificial Sequence
  chemically synthesized
SQVSPFKLPIEELEDRVFVNCNSSIYRASSLSNCRHTSSVEE

SEQ ID NO: 782 - protein, 42 aa, Artificial Sequence
  chemically synthesized
SQVSPFKLPIEELEDRVFVNCNYSIYRASSLSNCRHTSSVEE

SEQ ID NO: 783 - protein, 42 aa, Artificial Sequence
  chemically synthesized
SQVSPFKLPIEELEDRVFVNCNTTIYRASSLSNCRHTSSVEE

SEQ ID NO: 784 - protein, 42 aa, Artificial Sequence
  chemically synthesized
SQVSPFKLPIEELEDRVFVNCNTYIYRASSLSNCRHTSSVEE

SEQ ID NO: 785 - protein, 42 aa, Artificial Sequence
  chemically synthesized
SQVSPFKLPIEELEDRVFVNCNTSVYRASSLSNCRHTSSVEE

SEQ ID NO: 786 - protein, 42 aa, Artificial Sequence
  chemically synthesized
SQVSPFKLPIEELEDRVFVNCNTSLYRASSLSNCRHTSSVEE

SEQ ID NO: 787 - protein, 42 aa, Artificial Sequence
  chemically synthesized
SQVSPFKLPIEELEDRVFVNCNTSHYRASSLSNCRHTSSVEE

SEQ ID NO: 788 - protein, 42 aa, Artificial Sequence
  chemically synthesized
SQVSPFKLPIEELEDRVFVNCNTSFYRASSLSNCRHTSSVEE

SEQ ID NO: 789 - protein, 42 aa, Artificial Sequence
  chemically synthesized
SQVSPFKLPIEELEDRVFVNCNTSMYRASSLSNCRHTSSVEE

SEQ ID NO: 790 - protein, 42 aa, Artificial Sequence
  chemically synthesized
SQVSPFKLPIEELEDRVFVNCNTSIWRASSLSNCRHTSSVEE

SEQ ID NO: 791 - protein, 42 aa, Artificial Sequence
  chemically synthesized
SQVSPFKLPIEELEDRVFVNCNTSIFRASSLSNCRHTSSVEE

SEQ ID NO: 792 - protein, 42 aa, Artificial Sequence
  chemically synthesized
SQVSPFKLPIEELEDRVFVNCNTSISRASSLSNCRHTSSVEE

SEQ ID NO: 793 - protein, 42 aa, Artificial Sequence
  chemically synthesized
SQVSPFKLPIEELEDRVFVNCNTSITRASSLSNCRHTSSVEE

SEQ ID NO: 794 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKLPIEELEDRVFVNCNTSIYXASSLSNCRHTSSVEE

SEQ ID NO: 795 - protein, 42 aa, Artificial Sequence
  chemically synthesized
SQVSPFKLPIEELEDRVFVNCNTSIYHASSLSNCRHTSSVEE

SEQ ID NO: 796 - protein, 42 aa, Artificial Sequence
  chemically synthesized
SQVSPFKLPIEELEDRVFVNCNTSIYKASSLSNCRHTSSVEE

SEQ ID NO: 797 - protein, 42 aa, Artificial Sequence
  chemically synthesized
SQVSPFKLPIEELEDRVFVNCNTSIYRGSSLSNCRHTSSVEE

SEQ ID NO: 798 - protein, 42 aa, Artificial Sequence
  chemically synthesized
SQVSPFKLPIEELEDRVFVNCNTSIYRATSLSNCRHTSSVEE

SEQ ID NO: 799 - protein, 42 aa, Artificial Sequence
  chemically synthesized
SQVSPFKLPIEELEDRVFVNCNTSIYRAYSLSNCRHTSSVEE

SEQ ID NO: 800 - protein, 42 aa, Artificial Sequence
  chemically synthesized
SQVSPFKLPIEELEDRVFVNCNTSIYRASTLSNCRHTSSVEE

SEQ ID NO: 801 - protein, 42 aa, Artificial Sequence
  chemically synthesized
SQVSPFKLPIEELEDRVFVNCNTSIYRASYLSNCRHTSSVEE

SEQ ID NO: 802 - protein, 42 aa, Artificial Sequence
  chemically synthesized
SQVSPFKLPIEELEDRVFVNCNTSIYRASSISNCRHTSSVEE

SEQ ID NO: 803 - protein, 42 aa, Artificial Sequence
  chemically synthesized
SQVSPFKLPIEELEDRVFVNCNTSIYRASSVSNCRHTSSVEE

SEQ ID NO: 804 - protein, 42 aa, Artificial Sequence
  chemically synthesized
SQVSPFKLPIEELEDRVFVNCNTSIYRASSFSNCRHTSSVEE

SEQ ID NO: 805 - protein, 42 aa, Artificial Sequence
  chemically synthesized
SQVSPFKLPIEELEDRVFVNCNTSIYRASSMSNCRHTSSVEE

SEQ ID NO: 806 - protein, 42 aa, Artificial Sequence
  chemically synthesized
SQVSPFKLPIEELEDRVFVNCNTSIYRASSHSNCRHTSSVEE

SEQ ID NO: 807 - protein, 42 aa, Artificial Sequence
  chemically synthesized
SQVSPFKLPIEELEDRVFVNCNTSIYRASSLTNCRHTSSVEE

SEQ ID NO: 808 - protein, 42 aa, Artificial Sequence
  chemically synthesized
SQVSPFKLPIEELEDRVFVNCNTSIYRASSLYNCRHTSSVEE

SEQ ID NO: 809 - protein, 42 aa, Artificial Sequence
  chemically synthesized
SQVSPFKLPIEELEDRVFVNCNTSIYRASSLSQCRHTSSVEE

SEQ ID NO: 810 - protein, 42 aa, Artificial Sequence
  chemically synthesized
SQVSPFKLPIEELEDRVFVNCNTSIYRASSLSNSRHTSSVEE

SEQ ID NO: 811 - protein, 42 aa, Artificial Sequence
  chemically synthesized
SQVSPFKLPIEELEDRVFVNCNTSIYRASSLSNGRHTSSVEE

SEQ ID NO: 812 - protein, 42 aa, Artificial Sequence
  chemically synthesized
SQVSPFKLPIEELEDRVFVNCNTSIYRASSLSNARHTSSVEE

SEQ ID NO: 813 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKLPIEELEDRVFVNCNTSIYRASSLSNCXHTSSVEE

SEQ ID NO: 814 - protein, 42 aa, Artificial Sequence
  chemically synthesized
SQVSPFKLPIEELEDRVFVNCNTSIYRASSLSNCHHTSSVEE

SEQ ID NO: 815 - protein, 42 aa, Artificial Sequence
  chemically synthesized
SQVSPFKLPIEELEDRVFVNCNTSIYRASSLSNCKHTSSVEE

SEQ ID NO: 816 - protein, 42 aa, Artificial Sequence
  chemically synthesized
SQVSPFKLPIEELEDRVFVNCNTSIYRASSLSNCRGTSSVEE

SEQ ID NO: 817 - protein, 42 aa, Artificial Sequence
  chemically synthesized
SQVSPFKLPIEELEDRVFVNCNTSIYRASSLSNCRATSSVEE

SEQ ID NO: 818 - protein, 42 aa, Artificial Sequence
  chemically synthesized
SQVSPFKLPIEELEDRVFVNCNTSIYRASSLSNCRITSSVEE

SEQ ID NO: 819 - protein, 42 aa, Artificial Sequence
  chemically synthesized
SQVSPFKLPIEELEDRVFVNCNTSIYRASSLSNCRLTSSVEE

SEQ ID NO: 820 - protein, 42 aa, Artificial Sequence
  chemically synthesized
SQVSPFKLPIEELEDRVFVNCNTSIYRASSLSNCRMTSSVEE

SEQ ID NO: 821 - protein, 42 aa, Artificial Sequence
  chemically synthesized
SQVSPFKLPIEELEDRVFVNCNTSIYRASSLSNCRVTSSVEE

SEQ ID NO: 822 - protein, 42 aa, Artificial Sequence
  chemically synthesized
SQVSPFKLPIEELEDRVFVNCNTSIYRASSLSNCRHSSSVEE

SEQ ID NO: 823 - protein, 42 aa, Artificial Sequence
  chemically synthesized
SQVSPFKLPIEELEDRVFVNCNTSIYRASSLSNCRHYSSVEE

SEQ ID NO: 824 - protein, 42 aa, Artificial Sequence
  chemically synthesized
SQVSPFKLPIEELEDRVFVNCNTSIYRASSLSNCRHTTSVEE

SEQ ID NO: 825 - protein, 42 aa, Artificial Sequence
  chemically synthesized
SQVSPFKLPIEELEDRVFVNCNTSIYRASSLSNCRHTYSVEE

SEQ ID NO: 826 - protein, 42 aa, Artificial Sequence
  chemically synthesized
SQVSPFKLPIEELEDRVFVNCNTSIYRASSLSNCRHTSTVEE

SEQ ID NO: 827 - protein, 42 aa, Artificial Sequence
  chemically synthesized
SQVSPFKLPIEELEDRVFVNCNTSIYRASSLSNCRHTSYVEE

SEQ ID NO: 828 - protein, 42 aa, Artificial Sequence
  chemically synthesized
SQVSPFKLPIEELEDRVFVNCNTSIYRASSLSNCRHTSSIEE

SEQ ID NO: 829 - protein, 42 aa, Artificial Sequence
  chemically synthesized
SQVSPFKLPIEELEDRVFVNCNTSIYRASSLSNCRHTSSLEE

SEQ ID NO: 830 - protein, 42 aa, Artificial Sequence
  chemically synthesized
SQVSPFKLPIEELEDRVFVNCNTSIYRASSLSNCRHTSSFEE

SEQ ID NO: 831 - protein, 42 aa, Artificial Sequence
  chemically synthesized
SQVSPFKLPIEELEDRVFVNCNTSIYRASSLSNCRHTSSHEE

SEQ ID NO: 832 - protein, 42 aa, Artificial Sequence
  chemically synthesized
SQVSPFKLPIEELEDRVFVNCNTSIYRASSLSNCRHTSSMEE

SEQ ID NO: 833 - protein, 42 aa, Artificial Sequence
  chemically synthesized
SQVSPFKLPIEELEDRVFVNCNTSIYRASSLSNCRHTSSVDE

SEQ ID NO: 834 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKLPIEELEDRVFVNCNTSIYRASSLSNCRHTSSVXE

SEQ ID NO: 835 - protein, 42 aa, Artificial Sequence
  chemically synthesized
SQVSPFKLPIEELEDRVFVNCNTSIYRASSLSNCRHTSSVED

SEQ ID NO: 836 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKLPIEELEDRVFVNCNTSIYRASSLSNCRHTSSVEX

SEQ ID NO: 837 - protein, 42 aa, Artificial Sequence
  chemically synthesized
SQVSAFKLPIEELEDRVFVNCNTSIYRASSLSNCRHTSSVEE

SEQ ID NO: 838 - protein, 42 aa, Artificial Sequence
  chemically synthesized
SQVSGFKLPIEELEDRVFVNCNTSIYRASSLSNCRHTSSVEE

SEQ ID NO: 839 - protein, 42 aa, Artificial Sequence
  chemically synthesized
SQVSPFKLAIEELEDRVFVNCNTSIYRASSLSNCRHTSSVEE

SEQ ID NO: 840 - protein, 42 aa, Artificial Sequence
  chemically synthesized
SQVSPFKLGIEELEDRVFVNCNTSIYRASSLSNCRHTSSVEE

SEQ ID NO: 841 - protein, 42 aa, Artificial Sequence; identical to SEQ ID NO: 25
  chemically synthesized

SEQ ID NO: 842 - protein, 42 aa, Artificial Sequence; identical to SEQ ID NO: 144
  chemically synthesized

SEQ ID NO: 843 - protein, 42 aa, Artificial Sequence
  chemically synthesized
YQVSPFKIPLEELEDRVFVNCNTSIYRASSLSNCRHTSSVEE

SEQ ID NO: 844 - protein, 42 aa, Artificial Sequence; identical to SEQ ID NO: 264
  chemically synthesized

SEQ ID NO: 845 - protein, 42 aa, Artificial Sequence; identical to SEQ ID NO: 382
  chemically synthesized

SEQ ID NO: 846 - protein, 42 aa, Artificial Sequence
  chemically synthesized
SQISPFKIPLEELEDRVFVNCNTSIYRASSLSNCRHTSSVEE

SEQ ID NO: 847 - protein, 42 aa, Artificial Sequence
  chemically synthesized
SQPSPFKIPLEELEDRVFVNCNTSIYRASSLSNCRHTSSVEE

SEQ ID NO: 848 - protein, 42 aa, Artificial Sequence
  chemically synthesized
SQFSPFKIPLEELEDRVFVNCNTSIYRASSLSNCRHTSSVEE

SEQ ID NO: 849 - protein, 42 aa, Artificial Sequence; identical to SEQ ID NO: 501
  chemically synthesized

SEQ ID NO: 850 - protein, 42 aa, Artificial Sequence
  chemically synthesized
SQVYPFKIPLEELEDRVFVNCNTSIYRASSLSNCRHTSSVEE

SEQ ID NO: 851 - protein, 42 aa, Artificial Sequence
  chemically synthesized
SQVSPWKIPLEELEDRVFVNCNTSIYRASSLSNCRHTSSVEE

SEQ ID NO: 852 - protein, 42 aa, Artificial Sequence
  chemically synthesized
SQVSPYKIPLEELEDRVFVNCNTSIYRASSLSNCRHTSSVEE

SEQ ID NO: 853 - protein, 42 aa, Artificial Sequence
  chemically synthesized
SQVSPHKIPLEELEDRVFVNCNTSIYRASSLSNCRHTSSVEE

SEQ ID NO: 854 - protein, 42 aa, Artificial Sequence
  chemically synthesized
SQVSPFRIPLEELEDRVFVNCNTSIYRASSLSNCRHTSSVEE

SEQ ID NO: 855 - protein, 42 aa, Artificial Sequence
  chemically synthesized
SQVSPFHIPLEELEDRVFVNCNTSIYRASSLSNCRHTSSVEE

SEQ ID NO: 856 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPLEELEDRVFVNCNTSIYRASSLSNCRHTSSVEE

SEQ ID NO: 857 - protein, 42 aa, Artificial Sequence; identical to SEQ ID NO: 740
  chemically synthesized

SEQ ID NO: 858 - protein, 42 aa, Artificial Sequence
  chemically synthesized
SQVSPFKHPLEELEDRVFVNCNTSIYRASSLSNCRHTSSVEE

SEQ ID NO: 859 - protein, 42 aa, Artificial Sequence
  chemically synthesized
SQVSPFKVPLEELEDRVFVNCNTSIYRASSLSNCRHTSSVEE

SEQ ID NO: 860 - protein, 42 aa, Artificial Sequence
  chemically synthesized
SQVSPFKFPLEELEDRVFVNCNTSIYRASSLSNCRHTSSVEE

SEQ ID NO: 861 - protein, 42 aa, Artificial Sequence
  chemically synthesized
SQVSPFKMPLEELEDRVFVNCNTSIYRASSLSNCRHTSSVEE

SEQ ID NO: 862 - protein, 42 aa, Artificial Sequence; identical to SEQ ID NO: 25
  chemically synthesized

SEQ ID NO: 863 - protein, 42 aa, Artificial Sequence
  chemically synthesized
SQVSPFKIPLDELEDRVFVNCNTSIYRASSLSNCRHTSSVEE

SEQ ID NO: 864 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPLXELEDRVFVNCNTSIYRASSLSNCRHTSSVEE

SEQ ID NO: 865 - protein, 42 aa, Artificial Sequence
  chemically synthesized
SQVSPFKIPLEDLEDRVFVNCNTSIYRASSLSNCRHTSSVEE

SEQ ID NO: 866 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPLEXLEDRVFVNCNTSIYRASSLSNCRHTSSVEE

SEQ ID NO: 867 - protein, 42 aa, Artificial Sequence
  chemically synthesized
SQVSPFKIPLEEVEDRVFVNCNTSIYRASSLSNCRHTSSVEE

SEQ ID NO: 868 - protein, 42 aa, Artificial Sequence
  chemically synthesized
SQVSPFKIPLEEIEDRVFVNCNTSIYRASSLSNCRHTSSVEE

SEQ ID NO: 869 - protein, 42 aa, Artificial Sequence
  chemically synthesized
SQVSPFKIPLEEFEDRVFVNCNTSIYRASSLSNCRHTSSVEE

SEQ ID NO: 870 - protein, 42 aa, Artificial Sequence
  chemically synthesized
SQVSPFKIPLEEHEDRVFVNCNTSIYRASSLSNCRHTSSVEE

SEQ ID NO: 871 - protein, 42 aa, Artificial Sequence
  chemically synthesized
SQVSPFKIPLEEMEDRVFVNCNTSIYRASSLSNCRHTSSVEE

SEQ ID NO: 872 - protein, 42 aa, Artificial Sequence
  chemically synthesized
SQVSPFKIPLEELDDRVFVNCNTSIYRASSLSNCRHTSSVEE

SEQ ID NO: 873 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPLEELXDRVFVNCNTSIYRASSLSNCRHTSSVEE

SEQ ID NO: 874 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPLEELEXRVFVNCNTSIYRASSLSNCRHTSSVEE

SEQ ID NO: 875 - protein, 42 aa, Artificial Sequence
  chemically synthesized
SQVSPFKIPLEELEERVFVNCNTSIYRASSLSNCRHTSSVEE

SEQ ID NO: 876 - protein, 42 aa, Artificial Sequence
  chemically synthesized
SQVSPFKIPLEELEDKVFVNCNTSIYRASSLSNCRHTSSVEE

SEQ ID NO: 877 - protein, 42 aa, Artificial Sequence
  chemically synthesized
SQVSPFKIPLEELEDHVFVNCNTSIYRASSLSNCRHTSSVEE

SEQ ID NO: 878 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPLEELEDXVFVNCNTSIYRASSLSNCRHTSSVEE

SEQ ID NO: 879 - protein, 42 aa, Artificial Sequence
  chemically synthesized
SQVSPFKIPLEELEDRIFVNCNTSIYRASSLSNCRHTSSVEE

SEQ ID NO: 880 - protein, 42 aa, Artificial Sequence
  chemically synthesized
SQVSPFKIPLEELEDRLFVNCNTSIYRASSLSNCRHTSSVEE

SEQ ID NO: 881 - protein, 42 aa, Artificial Sequence
  chemically synthesized
SQVSPFKIPLEELEDRFFVNCNTSIYRASSLSNCRHTSSVEE

SEQ ID NO: 882 - protein, 42 aa, Artificial Sequence
  chemically synthesized
SQVSPFKIPLEELEDRHFVNCNTSIYRASSLSNCRHTSSVEE

SEQ ID NO: 883 - protein, 42 aa, Artificial Sequence
  chemically synthesized
SQVSPFKIPLEELEDRMFVNCNTSIYRASSLSNCRHTSSVEE

SEQ ID NO: 884 - protein, 42 aa, Artificial Sequence
  chemically synthesized
SQVSPFKIPLEELEDRVIVNCNTSIYRASSLSNCRHTSSVEE

SEQ ID NO: 885 - protein, 42 aa, Artificial Sequence
  chemically synthesized
SQVSPFKIPLEELEDRVLVNCNTSIYRASSLSNCRHTSSVEE

SEQ ID NO: 886 - protein, 42 aa, Artificial Sequence
  chemically synthesized
SQVSPFKIPLEELEDRVVVNCNTSIYRASSLSNCRHTSSVEE

SEQ ID NO: 887 - protein, 42 aa, Artificial Sequence
  chemically synthesized
SQVSPFKIPLEELEDRVHVNCNTSIYRASSLSNCRHTSSVEE

SEQ ID NO: 888 - protein, 42 aa, Artificial Sequence
  chemically synthesized
SQVSPFKIPLEELEDRVMVNCNTSIYRASSLSNCRHTSSVEE

SEQ ID NO: 889 - protein, 42 aa, Artificial Sequence
  chemically synthesized
SQVSPFKIPLEELEDRVFINCNTSIYRASSLSNCRHTSSVEE

SEQ ID NO: 890 - protein, 42 aa, Artificial Sequence
  chemically synthesized
SQVSPFKIPLEELEDRVFLNCNTSIYRASSLSNCRHTSSVEE

SEQ ID NO: 891 - protein, 42 aa, Artificial Sequence
  chemically synthesized
SQVSPFKIPLEELEDRVFFNCNTSIYRASSLSNCRHTSSVEE

SEQ ID NO: 892 - protein, 42 aa, Artificial Sequence
  chemically synthesized
SQVSPFKIPLEELEDRVFHNCNTSIYRASSLSNCRHTSSVEE

SEQ ID NO: 893 - protein, 42 aa, Artificial Sequence
  chemically synthesized
SQVSPFKIPLEELEDRVFMNCNTSIYRASSLSNCRHTSSVEE

SEQ ID NO: 894 - protein, 42 aa, Artificial Sequence
  chemically synthesized
SQVSPFKIPLEELEDRVFVQCNTSIYRASSLSNCRHTSSVEE

SEQ ID NO: 895 - protein, 42 aa, Artificial Sequence
  chemically synthesized
SQVSPFKIPLEELEDRVFVNSNTSIYRASSLSNCRHTSSVEE

SEQ ID NO: 896 - protein, 42 aa, Artificial Sequence
  chemically synthesized
SQVSPFKIPLEELEDRVFVNGNTSIYRASSLSNCRHTSSVEE

SEQ ID NO: 897 - protein, 42 aa, Artificial Sequence
  chemically synthesized
SQVSPFKIPLEELEDRVFVNANTSIYRASSLSNCRHTSSVEE

SEQ ID NO: 898 - protein, 42 aa, Artificial Sequence
  chemically synthesized
SQVSPFKIPLEELEDRVFVNCQTSIYRASSLSNCRHTSSVEE

SEQ ID NO: 899 - protein, 42 aa, Artificial Sequence
  chemically synthesized
SQVSPFKIPLEELEDRVFVNCNSSIYRASSLSNCRHTSSVEE

SEQ ID NO: 900 - protein, 42 aa, Artificial Sequence
  chemically synthesized
SQVSPFKIPLEELEDRVFVNCNYSIYRASSLSNCRHTSSVEE

SEQ ID NO: 901 - protein, 42 aa, Artificial Sequence
  chemically synthesized
SQVSPFKIPLEELEDRVFVNCNTTIYRASSLSNCRHTSSVEE

SEQ ID NO: 902 - protein, 42 aa, Artificial Sequence
  chemically synthesized
SQVSPFKIPLEELEDRVFVNCNTYIYRASSLSNCRHTSSVEE

SEQ ID NO: 903 - protein, 42 aa, Artificial Sequence
  chemically synthesized
SQVSPFKIPLEELEDRVFVNCNTSVYRASSLSNCRHTSSVEE

SEQ ID NO: 904 - protein, 42 aa, Artificial Sequence
  chemically synthesized
SQVSPFKIPLEELEDRVFVNCNTSLYRASSLSNCRHTSSVEE

SEQ ID NO: 905 - protein, 42 aa, Artificial Sequence
  chemically synthesized
SQVSPFKIPLEELEDRVFVNCNTSHYRASSLSNCRHTSSVEE

SEQ ID NO: 906 - protein, 42 aa, Artificial Sequence
  chemically synthesized
SQVSPFKIPLEELEDRVFVNCNTSFYRASSLSNCRHTSSVEE

SEQ ID NO: 907 - protein, 42 aa, Artificial Sequence
  chemically synthesized
SQVSPFKIPLEELEDRVFVNCNTSMYRASSLSNCRHTSSVEE

SEQ ID NO: 908 - protein, 42 aa, Artificial Sequence
  chemically synthesized
SQVSPFKIPLEELEDRVFVNCNTSIWRASSLSNCRHTSSVEE

SEQ ID NO: 909 - protein, 42 aa, Artificial Sequence
  chemically synthesized
SQVSPFKIPLEELEDRVFVNCNTSIFRASSLSNCRHTSSVEE

SEQ ID NO: 910 - protein, 42 aa, Artificial Sequence
  chemically synthesized
SQVSPFKIPLEELEDRVFVNCNTSISRASSLSNCRHTSSVEE

SEQ ID NO: 911 - protein, 42 aa, Artificial Sequence
  chemically synthesized
SQVSPFKIPLEELEDRVFVNCNTSITRASSLSNCRHTSSVEE

SEQ ID NO: 912 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPLEELEDRVFVNCNTSIYXASSLSNCRHTSSVEE

SEQ ID NO: 913 - protein, 42 aa, Artificial Sequence
  chemically synthesized
SQVSPFKIPLEELEDRVFVNCNTSIYHASSLSNCRHTSSVEE

SEQ ID NO: 914 - protein, 42 aa, Artificial Sequence
  chemically synthesized
SQVSPFKIPLEELEDRVFVNCNTSIYKASSLSNCRHTSSVEE

SEQ ID NO: 915 - protein, 42 aa, Artificial Sequence
  chemically synthesized
SQVSPFKIPLEELEDRVFVNCNTSIYRGSSLSNCRHTSSVEE

SEQ ID NO: 916 - protein, 42 aa, Artificial Sequence
  chemically synthesized
SQVSPFKIPLEELEDRVFVNCNTSIYRATSLSNCRHTSSVEE

SEQ ID NO: 917 - protein, 42 aa, Artificial Sequence
  chemically synthesized
SQVSPFKIPLEELEDRVFVNCNTSIYRAYSLSNCRHTSSVEE

SEQ ID NO: 918 - protein, 42 aa, Artificial Sequence
  chemically synthesized
SQVSPFKIPLEELEDRVFVNCNTSIYRASTLSNCRHTSSVEE

SEQ ID NO: 919 - protein, 42 aa, Artificial Sequence
  chemically synthesized
SQVSPFKIPLEELEDRVFVNCNTSIYRASYLSNCRHTSSVEE

SEQ ID NO: 920 - protein, 42 aa, Artificial Sequence
  chemically synthesized
SQVSPFKIPLEELEDRVFVNCNTSIYRASSISNCRHTSSVEE

SEQ ID NO: 921 - protein, 42 aa, Artificial Sequence
  chemically synthesized
SQVSPFKIPLEELEDRVFVNCNTSIYRASSVSNCRHTSSVEE

SEQ ID NO: 922 - protein, 42 aa, Artificial Sequence
  chemically synthesized
SQVSPFKIPLEELEDRVFVNCNTSIYRASSFSNCRHTSSVEE

SEQ ID NO: 923 - protein, 42 aa, Artificial Sequence
  chemically synthesized
SQVSPFKIPLEELEDRVFVNCNTSIYRASSMSNCRHTSSVEE

SEQ ID NO: 924 - protein, 42 aa, Artificial Sequence
  chemically synthesized
SQVSPFKIPLEELEDRVFVNCNTSIYRASSHSNCRHTSSVEE

SEQ ID NO: 925 - protein, 42 aa, Artificial Sequence
  chemically synthesized
SQVSPFKIPLEELEDRVFVNCNTSIYRASSLTNCRHTSSVEE

SEQ ID NO: 926 - protein, 42 aa, Artificial Sequence
  chemically synthesized
SQVSPFKIPLEELEDRVFVNCNTSIYRASSLYNCRHTSSVEE

SEQ ID NO: 927 - protein, 42 aa, Artificial Sequence
  chemically synthesized
SQVSPFKIPLEELEDRVFVNCNTSIYRASSLSQCRHTSSVEE

SEQ ID NO: 928 - protein, 42 aa, Artificial Sequence
  chemically synthesized
SQVSPFKIPLEELEDRVFVNCNTSIYRASSLSNSRHTSSVEE

SEQ ID NO: 929 - protein, 42 aa, Artificial Sequence
  chemically synthesized
SQVSPFKIPLEELEDRVFVNCNTSIYRASSLSNGRHTSSVEE

SEQ ID NO: 930 - protein, 42 aa, Artificial Sequence
  chemically synthesized
SQVSPFKIPLEELEDRVFVNCNTSIYRASSLSNARHTSSVEE

SEQ ID NO: 931 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPLEELEDRVFVNCNTSIYRASSLSNCXHTSSVEE

SEQ ID NO: 932 - protein, 42 aa, Artificial Sequence
  chemically synthesized
SQVSPFKIPLEELEDRVFVNCNTSIYRASSLSNCHHTSSVEE

SEQ ID NO: 933 - protein, 42 aa, Artificial Sequence
  chemically synthesized
SQVSPFKIPLEELEDRVFVNCNTSIYRASSLSNCKHTSSVEE

SEQ ID NO: 934 - protein, 42 aa, Artificial Sequence
  chemically synthesized
SQVSPFKIPLEELEDRVFVNCNTSIYRASSLSNCRGTSSVEE

SEQ ID NO: 935 - protein, 42 aa, Artificial Sequence
  chemically synthesized
SQVSPFKIPLEELEDRVFVNCNTSIYRASSLSNCRATSSVEE

SEQ ID NO: 936 - protein, 42 aa, Artificial Sequence
  chemically synthesized
SQVSPFKIPLEELEDRVFVNCNTSIYRASSLSNCRITSSVEE

SEQ ID NO: 937 - protein, 42 aa, Artificial Sequence
  chemically synthesized
SQVSPFKIPLEELEDRVFVNCNTSIYRASSLSNCRLTSSVEE

SEQ ID NO: 938 - protein, 42 aa, Artificial Sequence
  chemically synthesized
SQVSPFKIPLEELEDRVFVNCNTSIYRASSLSNCRMTSSVEE

SEQ ID NO: 939 - protein, 42 aa, Artificial Sequence
  chemically synthesized
SQVSPFKIPLEELEDRVFVNCNTSIYRASSLSNCRVTSSVEE

SEQ ID NO: 940 - protein, 42 aa, Artificial Sequence
  chemically synthesized
SQVSPFKIPLEELEDRVFVNCNTSIYRASSLSNCRHSSSVEE

SEQ ID NO: 941 - protein, 42 aa, Artificial Sequence
  chemically synthesized
SQVSPFKIPLEELEDRVFVNCNTSIYRASSLSNCRHYSSVEE

SEQ ID NO: 942 - protein, 42 aa, Artificial Sequence
  chemically synthesized
SQVSPFKIPLEELEDRVFVNCNTSIYRASSLSNCRHTTSVEE

SEQ ID NO: 943 - protein, 42 aa, Artificial Sequence
  chemically synthesized
SQVSPFKIPLEELEDRVFVNCNTSIYRASSLSNCRHTYSVEE

SEQ ID NO: 944 - protein, 42 aa, Artificial Sequence
  chemically synthesized
SQVSPFKIPLEELEDRVFVNCNTSIYRASSLSNCRHTSTVEE

SEQ ID NO: 945 - protein, 42 aa, Artificial Sequence
  chemically synthesized
SQVSPFKIPLEELEDRVFVNCNTSIYRASSLSNCRHTSYVEE

SEQ ID NO: 946 - protein, 42 aa, Artificial Sequence
  chemically synthesized
SQVSPFKIPLEELEDRVFVNCNTSIYRASSLSNCRHTSSIEE

SEQ ID NO: 947 - protein, 42 aa, Artificial Sequence
  chemically synthesized
SQVSPFKIPLEELEDRVFVNCNTSIYRASSLSNCRHTSSLEE

SEQ ID NO: 948 - protein, 42 aa, Artificial Sequence
  chemically synthesized
SQVSPFKIPLEELEDRVFVNCNTSIYRASSLSNCRHTSSFEE

SEQ ID NO: 949 - protein, 42 aa, Artificial Sequence
  chemically synthesized
SQVSPFKIPLEELEDRVFVNCNTSIYRASSLSNCRHTSSHEE

SEQ ID NO: 950 - protein, 42 aa, Artificial Sequence
  chemically synthesized
SQVSPFKIPLEELEDRVFVNCNTSIYRASSLSNCRHTSSMEE

SEQ ID NO: 951 - protein, 42 aa, Artificial Sequence
  chemically synthesized
SQVSPFKIPLEELEDRVFVNCNTSIYRASSLSNCRHTSSVDE

SEQ ID NO: 952 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPLEELEDRVFVNCNTSIYRASSLSNCRHTSSVXE

SEQ ID NO: 953 - protein, 42 aa, Artificial Sequence
  chemically synthesized
SQVSPFKIPLEELEDRVFVNCNTSIYRASSLSNCRHTSSVED

SEQ ID NO: 954 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPLEELEDRVFVNCNTSIYRASSLSNCRHTSSVEX

SEQ ID NO: 955 - protein, 42 aa, Artificial Sequence
  chemically synthesized
SQVSAFKIPLEELEDRVFVNCNTSIYRASSLSNCRHTSSVEE

SEQ ID NO: 956 - protein, 42 aa, Artificial Sequence
  chemically synthesized
SQVSGFKIPLEELEDRVFVNCNTSIYRASSLSNCRHTSSVEE

SEQ ID NO: 957 - protein, 42 aa, Artificial Sequence
  chemically synthesized
SQVSPFKIALEELEDRVFVNCNTSIYRASSLSNCRHTSSVEE

SEQ ID NO: 958 - protein, 42 aa, Artificial Sequence
  chemically synthesized
SQVSPFKIGLEELEDRVFVNCNTSIYRASSLSNCRHTSSVEE

SEQ ID NO: 959 - protein, 42 aa, Artificial Sequence; identical to SEQ ID NO: 30
  chemically synthesized

SEQ ID NO: 960 - protein, 42 aa, Artificial Sequence; identical to SEQ ID NO: 149
  chemically synthesized

SEQ ID NO: 961 - protein, 42 aa, Artificial Sequence
  chemically synthesized
YQVSPFKIPIDELEDRVFVNCNTSIYRASSLSNCRHTSSVEE

SEQ ID NO: 962 - protein, 42 aa, Artificial Sequence; identical to SEQ ID NO: 269
  chemically synthesized

SEQ ID NO: 963 - protein, 42 aa, Artificial Sequence; identical to SEQ ID NO: 387
  chemically synthesized

SEQ ID NO: 964 - protein, 42 aa, Artificial Sequence
  chemically synthesized
SQISPFKIPIDELEDRVFVNCNTSIYRASSLSNCRHTSSVEE

SEQ ID NO: 965 - protein, 42 aa, Artificial Sequence
  chemically synthesized
SQPSPFKIPIDELEDRVFVNCNTSIYRASSLSNCRHTSSVEE

SEQ ID NO: 966 - protein, 42 aa, Artificial Sequence
  chemically synthesized
SQFSPFKIPIDELEDRVFVNCNTSIYRASSLSNCRHTSSVEE

SEQ ID NO: 967 - protein, 42 aa, Artificial Sequence; identical to SEQ ID NO: 506
  chemically synthesized

SEQ ID NO: 968 - protein, 42 aa, Artificial Sequence
  chemically synthesized
SQVYPFKIPIDELEDRVFVNCNTSIYRASSLSNCRHTSSVEE

SEQ ID NO: 969 - protein, 42 aa, Artificial Sequence
  chemically synthesized
SQVSPWKIPIDELEDRVFVNCNTSIYRASSLSNCRHTSSVEE

SEQ ID NO: 970 - protein, 42 aa, Artificial Sequence
  chemically synthesized
SQVSPYKIPIDELEDRVFVNCNTSIYRASSLSNCRHTSSVEE

SEQ ID NO: 971 - protein, 42 aa, Artificial Sequence
  chemically synthesized
SQVSPHKIPIDELEDRVFVNCNTSIYRASSLSNCRHTSSVEE

SEQ ID NO: 972 - protein, 42 aa, Artificial Sequence
  chemically synthesized
SQVSPFRIPIDELEDRVFVNCNTSIYRASSLSNCRHTSSVEE

SEQ ID NO: 973 - protein, 42 aa, Artificial Sequence
  chemically synthesized
SQVSPFHIPIDELEDRVFVNCNTSIYRASSLSNCRHTSSVEE

SEQ ID NO: 974 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIDELEDRVFVNCNTSIYRASSLSNCRHTSSVEE

SEQ ID NO: 975 - protein, 42 aa, Artificial Sequence; identical to SEQ ID NO: 745
  chemically synthesized

SEQ ID NO: 976 - protein, 42 aa, Artificial Sequence
  chemically synthesized
SQVSPFKHPIDELEDRVFVNCNTSIYRASSLSNCRHTSSVEE

SEQ ID NO: 977 - protein, 42 aa, Artificial Sequence
  chemically synthesized
SQVSPFKVPIDELEDRVFVNCNTSIYRASSLSNCRHTSSVEE

SEQ ID NO: 978 - protein, 42 aa, Artificial Sequence
  chemically synthesized
SQVSPFKFPIDELEDRVFVNCNTSIYRASSLSNCRHTSSVEE

SEQ ID NO: 979 - protein, 42 aa, Artificial Sequence
  chemically synthesized
SQVSPFKMPIDELEDRVFVNCNTSIYRASSLSNCRHTSSVEE

SEQ ID NO: 980 - protein, 42 aa, Artificial Sequence; identical to SEQ ID NO: 863
  chemically synthesized

SEQ ID NO: 981 - protein, 42 aa, Artificial Sequence
  chemically synthesized
SQVSPFKIPHDELEDRVFVNCNTSIYRASSLSNCRHTSSVEE

SEQ ID NO: 982 - protein, 42 aa, Artificial Sequence
  chemically synthesized
SQVSPFKIPVDELEDRVFVNCNTSIYRASSLSNCRHTSSVEE

SEQ ID NO: 983 - protein, 42 aa, Artificial Sequence
  chemically synthesized
SQVSPFKIPFDELEDRVFVNCNTSIYRASSLSNCRHTSSVEE

SEQ ID NO: 984 - protein, 42 aa, Artificial Sequence
  chemically synthesized
SQVSPFKIPMDELEDRVFVNCNTSIYRASSLSNCRHTSSVEE

SEQ ID NO: 985 - protein, 42 aa, Artificial Sequence
  chemically synthesized
SQVSPFKIPIDDLEDRVFVNCNTSIYRASSLSNCRHTSSVEE

SEQ ID NO: 986 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIDXLEDRVFVNCNTSIYRASSLSNCRHTSSVEE

SEQ ID NO: 987 - protein, 42 aa, Artificial Sequence
  chemically synthesized
SQVSPFKIPIDEVEDRVFVNCNTSIYRASSLSNCRHTSSVEE

SEQ ID NO: 988 - protein, 42 aa, Artificial Sequence
  chemically synthesized
SQVSPFKIPIDEIEDRVFVNCNTSIYRASSLSNCRHTSSVEE

SEQ ID NO: 989 - protein, 42 aa, Artificial Sequence
  chemically synthesized
SQVSPFKIPIDEFEDRVFVNCNTSIYRASSLSNCRHTSSVEE

SEQ ID NO: 990 - protein, 42 aa, Artificial Sequence
  chemically synthesized
SQVSPFKIPIDEHEDRVFVNCNTSIYRASSLSNCRHTSSVEE

SEQ ID NO: 991 - protein, 42 aa, Artificial Sequence
  chemically synthesized
SQVSPFKIPIDEMEDRVFVNCNTSIYRASSLSNCRHTSSVEE

SEQ ID NO: 992 - protein, 42 aa, Artificial Sequence
  chemically synthesized
SQVSPFKIPIDELDDRVFVNCNTSIYRASSLSNCRHTSSVEE

SEQ ID NO: 993 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIDELXDRVFVNCNTSIYRASSLSNCRHTSSVEE

SEQ ID NO: 994 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIDELEXRVFVNCNTSIYRASSLSNCRHTSSVEE

SEQ ID NO: 995 - protein, 42 aa, Artificial Sequence
  chemically synthesized
SQVSPFKIPIDELEERVFVNCNTSIYRASSLSNCRHTSSVEE

SEQ ID NO: 996 - protein, 42 aa, Artificial Sequence
  chemically synthesized
SQVSPFKIPIDELEDKVFVNCNTSIYRASSLSNCRHTSSVEE

SEQ ID NO: 997 - protein, 42 aa, Artificial Sequence
  chemically synthesized
SQVSPFKIPIDELEDHVFVNCNTSIYRASSLSNCRHTSSVEE

SEQ ID NO: 998 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIDELEDXVFVNCNTSIYRASSLSNCRHTSSVEE

SEQ ID NO: 999 - protein, 42 aa, Artificial Sequence
  chemically synthesized
SQVSPFKIPIDELEDRIFVNCNTSIYRASSLSNCRHTSSVEE

SEQ ID NO: 1000 - protein, 42 aa, Artificial Sequence
  chemically synthesized
SQVSPFKIPIDELEDRLFVNCNTSIYRASSLSNCRHTSSVEE

SEQ ID NO: 1001 - protein, 42 aa, Artificial Sequence
  chemically synthesized
SQVSPFKIPIDELEDRFFVNCNTSIYRASSLSNCRHTSSVEE

SEQ ID NO: 1002 - protein, 42 aa, Artificial Sequence
  chemically synthesized
SQVSPFKIPIDELEDRHFVNCNTSIYRASSLSNCRHTSSVEE

SEQ ID NO: 1003 - protein, 42 aa, Artificial Sequence
  chemically synthesized
SQVSPFKIPIDELEDRMFVNCNTSIYRASSLSNCRHTSSVEE

SEQ ID NO: 1004 - protein, 42 aa, Artificial Sequence
  chemically synthesized
SQVSPFKIPIDELEDRVIVNCNTSIYRASSLSNCRHTSSVEE

SEQ ID NO: 1005 - protein, 42 aa, Artificial Sequence
  chemically synthesized
SQVSPFKIPIDELEDRVLVNCNTSIYRASSLSNCRHTSSVEE

SEQ ID NO: 1006 - protein, 42 aa, Artificial Sequence
  chemically synthesized
SQVSPFKIPIDELEDRVVVNCNTSIYRASSLSNCRHTSSVEE

SEQ ID NO: 1007 - protein, 42 aa, Artificial Sequence
  chemically synthesized
SQVSPFKIPIDELEDRVHVNCNTSIYRASSLSNCRHTSSVEE

SEQ ID NO: 1008 - protein, 42 aa, Artificial Sequence
  chemically synthesized
SQVSPFKIPIDELEDRVMVNCNTSIYRASSLSNCRHTSSVEE

SEQ ID NO: 1009 - protein, 42 aa, Artificial Sequence
  chemically synthesized
SQVSPFKIPIDELEDRVFINCNTSIYRASSLSNCRHTSSVEE

SEQ ID NO: 1010 - protein, 42 aa, Artificial Sequence
  chemically synthesized
SQVSPFKIPIDELEDRVFLNCNTSIYRASSLSNCRHTSSVEE

SEQ ID NO: 1011 - protein, 42 aa, Artificial Sequence
  chemically synthesized
SQVSPFKIPIDELEDRVFFNCNTSIYRASSLSNCRHTSSVEE

SEQ ID NO: 1012 - protein, 42 aa, Artificial Sequence
  chemically synthesized
SQVSPFKIPIDELEDRVFHNCNTSIYRASSLSNCRHTSSVEE

SEQ ID NO: 1013 - protein, 42 aa, Artificial Sequence
  chemically synthesized
SQVSPFKIPIDELEDRVFMNCNTSIYRASSLSNCRHTSSVEE

SEQ ID NO: 1014 - protein, 42 aa, Artificial Sequence
  chemically synthesized
SQVSPFKIPIDELEDRVFVQCNTSIYRASSLSNCRHTSSVEE

SEQ ID NO: 1015 - protein, 42 aa, Artificial Sequence
  chemically synthesized
SQVSPFKIPIDELEDRVFVNSNTSIYRASSLSNCRHTSSVEE

SEQ ID NO: 1016 - protein, 42 aa, Artificial Sequence
  chemically synthesized
SQVSPFKIPIDELEDRVFVNGNTSIYRASSLSNCRHTSSVEE

SEQ ID NO: 1017 - protein, 42 aa, Artificial Sequence
  chemically synthesized
SQVSPFKIPIDELEDRVFVNANTSIYRASSLSNCRHTSSVEE

SEQ ID NO: 1018 - protein, 42 aa, Artificial Sequence
  chemically synthesized
SQVSPFKIPIDELEDRVFVNCQTSIYRASSLSNCRHTSSVEE

SEQ ID NO: 1019 - protein, 42 aa, Artificial Sequence
  chemically synthesized
SQVSPFKIPIDELEDRVFVNCNSSIYRASSLSNCRHTSSVEE

SEQ ID NO: 1020 - protein, 42 aa, Artificial Sequence
  chemically synthesized
SQVSPFKIPIDELEDRVFVNCNYSIYRASSLSNCRHTSSVEE

SEQ ID NO: 1021 - protein, 42 aa, Artificial Sequence
  chemically synthesized
SQVSPFKIPIDELEDRVFVNCNTTIYRASSLSNCRHTSSVEE

SEQ ID NO: 1022 - protein, 42 aa, Artificial Sequence
  chemically synthesized
SQVSPFKIPIDELEDRVFVNCNTYIYRASSLSNCRHTSSVEE

SEQ ID NO: 1023 - protein, 42 aa, Artificial Sequence
  chemically synthesized
SQVSPFKIPIDELEDRVFVNCNTSVYRASSLSNCRHTSSVEE

SEQ ID NO: 1024 - protein, 42 aa, Artificial Sequence
  chemically synthesized
SQVSPFKIPIDELEDRVFVNCNTSLYRASSLSNCRHTSSVEE

SEQ ID NO: 1025 - protein, 42 aa, Artificial Sequence
  chemically synthesized
SQVSPFKIPIDELEDRVFVNCNTSHYRASSLSNCRHTSSVEE

SEQ ID NO: 1026 - protein, 42 aa, Artificial Sequence
  chemically synthesized
SQVSPFKIPIDELEDRVFVNCNTSFYRASSLSNCRHTSSVEE

SEQ ID NO: 1027 - protein, 42 aa, Artificial Sequence
  chemically synthesized
SQVSPFKIPIDELEDRVFVNCNTSMYRASSLSNCRHTSSVEE

SEQ ID NO: 1028 - protein, 42 aa, Artificial Sequence
  chemically synthesized
SQVSPFKIPIDELEDRVFVNCNTSIWRASSLSNCRHTSSVEE

SEQ ID NO: 1029 - protein, 42 aa, Artificial Sequence
  chemically synthesized
SQVSPFKIPIDELEDRVFVNCNTSIFRASSLSNCRHTSSVEE

SEQ ID NO: 1030 - protein, 42 aa, Artificial Sequence
  chemically synthesized
SQVSPFKIPIDELEDRVFVNCNTSISRASSLSNCRHTSSVEE

SEQ ID NO: 1031 - protein, 42 aa, Artificial Sequence
  chemically synthesized
SQVSPFKIPIDELEDRVFVNCNTSITRASSLSNCRHTSSVEE

SEQ ID NO: 1032 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIDELEDRVFVNCNTSIYXASSLSNCRHTSSVEE

SEQ ID NO: 1033 - protein, 42 aa, Artificial Sequence
  chemically synthesized
SQVSPFKIPIDELEDRVFVNCNTSIYHASSLSNCRHTSSVEE

SEQ ID NO: 1034 - protein, 42 aa, Artificial Sequence
  chemically synthesized
SQVSPFKIPIDELEDRVFVNCNTSIYKASSLSNCRHTSSVEE

SEQ ID NO: 1035 - protein, 42 aa, Artificial Sequence
  chemically synthesized
SQVSPFKIPIDELEDRVFVNCNTSIYRGSSLSNCRHTSSVEE

SEQ ID NO: 1036 - protein, 42 aa, Artificial Sequence
  chemically synthesized
SQVSPFKIPIDELEDRVFVNCNTSIYRATSLSNCRHTSSVEE

SEQ ID NO: 1037 - protein, 42 aa, Artificial Sequence
  chemically synthesized
SQVSPFKIPIDELEDRVFVNCNTSIYRAYSLSNCRHTSSVEE

SEQ ID NO: 1038 - protein, 42 aa, Artificial Sequence
  chemically synthesized
SQVSPFKIPIDELEDRVFVNCNTSIYRASTLSNCRHTSSVEE

SEQ ID NO: 1039 - protein, 42 aa, Artificial Sequence
  chemically synthesized
SQVSPFKIPIDELEDRVFVNCNTSIYRASYLSNCRHTSSVEE

SEQ ID NO: 1040 - protein, 42 aa, Artificial Sequence
  chemically synthesized
SQVSPFKIPIDELEDRVFVNCNTSIYRASSISNCRHTSSVEE

SEQ ID NO: 1041 - protein, 42 aa, Artificial Sequence
  chemically synthesized
SQVSPFKIPIDELEDRVFVNCNTSIYRASSVSNCRHTSSVEE

SEQ ID NO: 1042 - protein, 42 aa, Artificial Sequence
  chemically synthesized
SQVSPFKIPIDELEDRVFVNCNTSIYRASSFSNCRHTSSVEE

SEQ ID NO: 1043 - protein, 42 aa, Artificial Sequence
  chemically synthesized
SQVSPFKIPIDELEDRVFVNCNTSIYRASSMSNCRHTSSVEE

SEQ ID NO: 1044 - protein, 42 aa, Artificial Sequence
  chemically synthesized
SQVSPFKIPIDELEDRVFVNCNTSIYRASSHSNCRHTSSVEE

SEQ ID NO: 1045 - protein, 42 aa, Artificial Sequence
  chemically synthesized
SQVSPFKIPIDELEDRVFVNCNTSIYRASSLTNCRHTSSVEE

SEQ ID NO: 1046 - protein, 42 aa, Artificial Sequence
  chemically synthesized
SQVSPFKIPIDELEDRVFVNCNTSIYRASSLYNCRHTSSVEE

SEQ ID NO: 1047 - protein, 42 aa, Artificial Sequence
  chemically synthesized
SQVSPFKIPIDELEDRVFVNCNTSIYRASSLSQCRHTSSVEE

SEQ ID NO: 1048 - protein, 42 aa, Artificial Sequence
  chemically synthesized
SQVSPFKIPIDELEDRVFVNCNTSIYRASSLSNSRHTSSVEE

SEQ ID NO: 1049 - protein, 42 aa, Artificial Sequence
  chemically synthesized
SQVSPFKIPIDELEDRVFVNCNTSIYRASSLSNGRHTSSVEE

SEQ ID NO: 1050 - protein, 42 aa, Artificial Sequence
  chemically synthesized
SQVSPFKIPIDELEDRVFVNCNTSIYRASSLSNARHTSSVEE

SEQ ID NO: 1051 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIDELEDRVFVNCNTSIYRASSLSNCXHTSSVEE

SEQ ID NO: 1052 - protein, 42 aa, Artificial Sequence
  chemically synthesized
SQVSPFKIPIDELEDRVFVNCNTSIYRASSLSNCHHTSSVEE

SEQ ID NO: 1053 - protein, 42 aa, Artificial Sequence
  chemically synthesized
SQVSPFKIPIDELEDRVFVNCNTSIYRASSLSNCKHTSSVEE

SEQ ID NO: 1054 - protein, 42 aa, Artificial Sequence
  chemically synthesized
SQVSPFKIPIDELEDRVFVNCNTSIYRASSLSNCRGTSSVEE

SEQ ID NO: 1055 - protein, 42 aa, Artificial Sequence
  chemically synthesized
SQVSPFKIPIDELEDRVFVNCNTSIYRASSLSNCRATSSVEE

SEQ ID NO: 1056 - protein, 42 aa, Artificial Sequence
  chemically synthesized
SQVSPFKIPIDELEDRVFVNCNTSIYRASSLSNCRITSSVEE

SEQ ID NO: 1057 - protein, 42 aa, Artificial Sequence
  chemically synthesized
SQVSPFKIPIDELEDRVFVNCNTSIYRASSLSNCRLTSSVEE

SEQ ID NO: 1058 - protein, 42 aa, Artificial Sequence
  chemically synthesized
SQVSPFKIPIDELEDRVFVNCNTSIYRASSLSNCRMTSSVEE

SEQ ID NO: 1059 - protein, 42 aa, Artificial Sequence
  chemically synthesized
SQVSPFKIPIDELEDRVFVNCNTSIYRASSLSNCRVTSSVEE

SEQ ID NO: 1060 - protein, 42 aa, Artificial Sequence
  chemically synthesized
SQVSPFKIPIDELEDRVFVNCNTSIYRASSLSNCRHSSSVEE

SEQ ID NO: 1061 - protein, 42 aa, Artificial Sequence
  chemically synthesized
SQVSPFKIPIDELEDRVFVNCNTSIYRASSLSNCRHYSSVEE

SEQ ID NO: 1062 - protein, 42 aa, Artificial Sequence
  chemically synthesized
SQVSPFKIPIDELEDRVFVNCNTSIYRASSLSNCRHTTSVEE

SEQ ID NO: 1063 - protein, 42 aa, Artificial Sequence
  chemically synthesized
SQVSPFKIPIDELEDRVFVNCNTSIYRASSLSNCRHTYSVEE

SEQ ID NO: 1064 - protein, 42 aa, Artificial Sequence
  chemically synthesized
SQVSPFKIPIDELEDRVFVNCNTSIYRASSLSNCRHTSTVEE

SEQ ID NO: 1065 - protein, 42 aa, Artificial Sequence
  chemically synthesized
SQVSPFKIPIDELEDRVFVNCNTSIYRASSLSNCRHTSYVEE

SEQ ID NO: 1066 - protein, 42 aa, Artificial Sequence
  chemically synthesized
SQVSPFKIPIDELEDRVFVNCNTSIYRASSLSNCRHTSSIDE

SEQ ID NO: 1067 - protein, 42 aa, Artificial Sequence
  chemically synthesized
SQVSPFKIPIDELEDRVFVNCNTSIYRASSLSNCRHTSSLEE

SEQ ID NO: 1068 - protein, 42 aa, Artificial Sequence
  chemically synthesized
SQVSPFKIPIDELEDRVFVNCNTSIYRASSLSNCRHTSSFEE

SEQ ID NO: 1069 - protein, 42 aa, Artificial Sequence
  chemically synthesized
SQVSPFKIPIDELEDRVFVNCNTSIYRASSLSNCRHTSSHEE

SEQ ID NO: 1070 - protein, 42 aa, Artificial Sequence
  chemically synthesized
SQVSPFKIPIDELEDRVFVNCNTSIYRASSLSNCRHTSSMEE

SEQ ID NO: 1071 - protein, 42 aa, Artificial Sequence; identical to SEQ ID NO: 30
  chemically synthesized

SEQ ID NO: 1072 - protein, 42 aa, Artificial Sequence; identical to SEQ ID NO: 30
  chemically synthesized

SEQ ID NO: 1073 - protein, 42 aa, Artificial Sequence
  chemically synthesized
SQVSPFKIPIDELEDRVFVNCNTSIYRASSLSNCRHTSSVED

SEQ ID NO: 1074 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIDELEDRVFVNCNTSIYRASSLSNCRHTSSVEX

SEQ ID NO: 1075 - protein, 42 aa, Artificial Sequence
  chemically synthesized
SQVSAFKIPIDELEDRVFVNCNTSIYRASSLSNCRHTSSVEE

SEQ ID NO: 1076 - protein, 42 aa, Artificial Sequence
  chemically synthesized
SQVSGFKIPIDELEDRVFVNCNTSIYRASSLSNCRHTSSVEE

SEQ ID NO: 1077 - protein, 42 aa, Artificial Sequence
  chemically synthesized
SQVSPFKIAIDELEDRVFVNCNTSIYRASSLSNCRHTSSVEE

SEQ ID NO: 1078 - protein, 42 aa, Artificial Sequence
  chemically synthesized
SQVSPFKIGIDELEDRVFVNCNTSIYRASSLSNCRHTSSVEE

SEQ ID NO: 1079 - protein, 42 aa, Artificial Sequence; identical to SEQ ID NO: 32
  chemically synthesized

SEQ ID NO: 1080 - protein, 42 aa, Artificial Sequence; identical to SEQ ID NO: 151
  chemically synthesized

SEQ ID NO: 1081 - protein, 42 aa, Artificial Sequence
  chemically synthesized
YQVSPFKIPIEDLEDRVFVNCNTSIYRASSLSNCRHTSSVEE

SEQ ID NO: 1082 - protein, 42 aa, Artificial Sequence; identical to SEQ ID NO: 271
  chemically synthesized

SEQ ID NO: 1083 - protein, 42 aa, Artificial Sequence; identical to SEQ ID NO: 389
  chemically synthesized

SEQ ID NO: 1084 - protein, 42 aa, Artificial Sequence
  chemically synthesized
SQISPFKIPIEDLEDRVFVNCNTSIYRASSLSNCRHTSSVEE

SEQ ID NO: 1085 - protein, 42 aa, Artificial Sequence
  chemically synthesized
SQPSPFKIPIEDLEDRVFVNCNTSIYRASSLSNCRHTSSVEE

SEQ ID NO: 1086 - protein, 42 aa, Artificial Sequence
  chemically synthesized
SQFSPFKIPIEDLEDRVFVNCNTSIYRASSLSNCRHTSSVEE

SEQ ID NO: 1087 - protein, 42 aa, Artificial Sequence; identical to SEQ ID NO: 508
  chemically synthesized

SEQ ID NO: 1088 - protein, 42 aa, Artificial Sequence
  chemically synthesized
SQVYPFKIPIEDLEDRVFVNCNTSIYRASSLSNCRHTSSVEE

SEQ ID NO: 1089 - protein, 42 aa, Artificial Sequence
  chemically synthesized
SQVSPWKIPIEDLEDRVFVNCNTSIYRASSLSNCRHTSSVEE

SEQ ID NO: 1090 - protein, 42 aa, Artificial Sequence
  chemically synthesized
SQVSPYKIPIEDLEDRVFVNCNTSIYRASSLSNCRHTSSVEE

SEQ ID NO: 1091 - protein, 42 aa, Artificial Sequence
  chemically synthesized
SQVSPHKIPIEDLEDRVFVNCNTSIYRASSLSNCRHTSSVEE

SEQ ID NO: 1092 - protein, 42 aa, Artificial Sequence
  chemically synthesized
SQVSPFRIPIEDLEDRVFVNCNTSIYRASSLSNCRHTSSVEE

SEQ ID NO: 1093 - protein, 42 aa, Artificial Sequence
  chemically synthesized
SQVSPFHIPIEDLEDRVFVNCNTSIYRASSLSNCRHTSSVEE

SEQ ID NO: 1094 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEDLEDRVFVNCNTSIYRASSLSNCRHTSSVEE

SEQ ID NO: 1095 - protein, 42 aa, Artificial Sequence; identical to SEQ ID NO: 747
  chemically synthesized

SEQ ID NO: 1096 - protein, 42 aa, Artificial Sequence
  chemically synthesized
SQVSPFKHPIEDLEDRVFVNCNTSIYRASSLSNCRHTSSVEE

SEQ ID NO: 1097 - protein, 42 aa, Artificial Sequence
  chemically synthesized
SQVSPFKVPIEDLEDRVFVNCNTSIYRASSLSNCRHTSSVEE

SEQ ID NO: 1098 - protein, 42 aa, Artificial Sequence
  chemically synthesized
SQVSPFKFPIEDLEDRVFVNCNTSIYRASSLSNCRHTSSVEE

SEQ ID NO: 1099 - protein, 42 aa, Artificial Sequence
  chemically synthesized
SQVSPFKMPIEDLEDRVFVNCNTSIYRASSLSNCRHTSSVEE

SEQ ID NO: 1100 - protein, 42 aa, Artificial Sequence; identical to SEQ ID NO: 865
  chemically synthesized

SEQ ID NO: 1101 - protein, 42 aa, Artificial Sequence
  chemically synthesized
SQVSPFKIPHEDLEDRVFVNCNTSIYRASSLSNCRHTSSVEE

SEQ ID NO: 1102 - protein, 42 aa, Artificial Sequence
  chemically synthesized
SQVSPFKIPVEDLEDRVFVNCNTSIYRASSLSNCRHTSSVEE

SEQ ID NO: 1103 - protein, 42 aa, Artificial Sequence
  chemically synthesized
SQVSPFKIPFEDLEDRVFVNCNTSIYRASSLSNCRHTSSVEE

SEQ ID NO: 1104 - protein, 42 aa, Artificial Sequence
  chemically synthesized
SQVSPFKIPMEDLEDRVFVNCNTSIYRASSLSNCRHTSSVEE

SEQ ID NO: 1105 - protein, 42 aa, Artificial Sequence; identical to SEQ ID NO: 985
  chemically synthesized

SEQ ID NO: 1106 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXDLEDRVFVNCNTSIYRASSLSNCRHTSSVEE

SEQ ID NO: 1107 - protein, 42 aa, Artificial Sequence
  chemically synthesized
SQVSPFKIPIEDVEDRVFVNCNTSIYRASSLSNCRHTSSVEE

SEQ ID NO: 1108 - protein, 42 aa, Artificial Sequence
  chemically synthesized
SQVSPFKIPIEDIEDRVFVNCNTSIYRASSLSNCRHTSSVEE

SEQ ID NO: 1109 - protein, 42 aa, Artificial Sequence
  chemically synthesized
SQVSPFKIPIEDFEDRVFVNCNTSIYRASSLSNCRHTSSVEE

SEQ ID NO: 1110 - protein, 42 aa, Artificial Sequence
  chemically synthesized
SQVSPFKIPIEDHEDRVFVNCNTSIYRASSLSNCRHTSSVEE

SEQ ID NO: 1111 - protein, 42 aa, Artificial Sequence
  chemically synthesized
SQVSPFKIPIEDMEDRVFVNCNTSIYRASSLSNCRHTSSVEE

SEQ ID NO: 1112 - protein, 42 aa, Artificial Sequence
  chemically synthesized
SQVSPFKIPIEDLDDRVFVNCNTSIYRASSLSNCRHTSSVEE

SEQ ID NO: 1113 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEDLXDRVFVNCNTSIYRASSLSNCRHTSSVEE

SEQ ID NO: 1114 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEDLEXRVFVNCNTSIYRASSLSNCRHTSSVEE

SEQ ID NO: 1115 - protein, 42 aa, Artificial Sequence
  chemically synthesized
SQVSPFKIPIEDLEERVFVNCNTSIYRASSLSNCRHTSSVEE

SEQ ID NO: 1116 - protein, 42 aa, Artificial Sequence
  chemically synthesized
SQVSPFKIPIEDLEDKVFVNCNTSIYRASSLSNCRHTSSVEE

SEQ ID NO: 1117 - protein, 42 aa, Artificial Sequence
  chemically synthesized
SQVSPFKIPIEDLEDHVFVNCNTSIYRASSLSNCRHTSSVEE

SEQ ID NO: 1118 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEDLEDXVFVNCNTSIYRASSLSNCRHTSSVEE

SEQ ID NO: 1119 - protein, 42 aa, Artificial Sequence
  chemically synthesized
SQVSPFKIPIEDLEDRIFVNCNTSIYRASSLSNCRHTSSVEE

SEQ ID NO: 1120 - protein, 42 aa, Artificial Sequence
  chemically synthesized
SQVSPFKIPIEDLEDRLFVNCNTSIYRASSLSNCRHTSSVEE

SEQ ID NO: 1121 - protein, 42 aa, Artificial Sequence
  chemically synthesized
SQVSPFKIPIEDLEDRFFVNCNTSIYRASSLSNCRHTSSVEE

SEQ ID NO: 1122 - protein, 42 aa, Artificial Sequence
  chemically synthesized
SQVSPFKIPIEDLEDRHFVNCNTSIYRASSLSNCRHTSSVEE

SEQ ID NO: 1123 - protein, 42 aa, Artificial Sequence
  chemically synthesized
SQVSPFKIPIEDLEDRMFVNCNTSIYRASSLSNCRHTSSVEE

SEQ ID NO: 1124 - protein, 42 aa, Artificial Sequence
  chemically synthesized
SQVSPFKIPIEDLEDRVIVNCNTSIYRASSLSNCRHTSSVEE

SEQ ID NO: 1125 - protein, 42 aa, Artificial Sequence
  chemically synthesized
SQVSPFKIPIEDLEDRVLVNCNTSIYRASSLSNCRHTSSVEE

SEQ ID NO: 1126 - protein, 42 aa, Artificial Sequence
  chemically synthesized
SQVSPFKIPIEDLEDRVVVNCNTSIYRASSLSNCRHTSSVEE

SEQ ID NO: 1127 - protein, 42 aa, Artificial Sequence
  chemically synthesized
SQVSPFKIPIEDLEDRVHVNCNTSIYRASSLSNCRHTSSVEE

SEQ ID NO: 1128 - protein, 42 aa, Artificial Sequence
  chemically synthesized
SQVSPFKIPIEDLEDRVMVNCNTSIYRASSLSNCRHTSSVEE

SEQ ID NO: 1129 - protein, 42 aa, Artificial Sequence
  chemically synthesized
SQVSPFKIPIEDLEDRVFINCNTSIYRASSLSNCRHTSSVEE

SEQ ID NO: 1130 - protein, 42 aa, Artificial Sequence
  chemically synthesized
SQVSPFKIPIEDLEDRVFLNCNTSIYRASSLSNCRHTSSVEE

SEQ ID NO: 1131 - protein, 42 aa, Artificial Sequence
  chemically synthesized
SQVSPFKIPIEDLEDRVFFNCNTSIYRASSLSNCRHTSSVEE

SEQ ID NO: 1132 - protein, 42 aa, Artificial Sequence
  chemically synthesized
SQVSPFKIPIEDLEDRVFHNCNTSIYRASSLSNCRHTSSVEE

SEQ ID NO: 1133 - protein, 42 aa, Artificial Sequence
  chemically synthesized
SQVSPFKIPIEDLEDRVFMNCNTSIYRASSLSNCRHTSSVEE

SEQ ID NO: 1134 - protein, 42 aa, Artificial Sequence
  chemically synthesized
SQVSPFKIPIEDLEDRVFVQCNTSIYRASSLSNCRHTSSVEE

SEQ ID NO: 1135 - protein, 42 aa, Artificial Sequence
  chemically synthesized
SQVSPFKIPIEDLEDRVFVNSNTSIYRASSLSNCRHTSSVEE

SEQ ID NO: 1136 - protein, 42 aa, Artificial Sequence
  chemically synthesized
SQVSPFKIPIEDLEDRVFVNGNTSIYRASSLSNCRHTSSVEE

SEQ ID NO: 1137 - protein, 42 aa, Artificial Sequence
  chemically synthesized
SQVSPFKIPIEDLEDRVFVNANTSIYRASSLSNCRHTSSVEE

SEQ ID NO: 1138 - protein, 42 aa, Artificial Sequence
  chemically synthesized
SQVSPFKIPIEDLEDRVFVNCQTSIYRASSLSNCRHTSSVEE

SEQ ID NO: 1139 - protein, 42 aa, Artificial Sequence
  chemically synthesized
SQVSPFKIPIEDLEDRVFVNCNSSIYRASSLSNCRHTSSVEE

SEQ ID NO: 1140 - protein, 42 aa, Artificial Sequence
  chemically synthesized
SQVSPFKIPIEDLEDRVFVNCNYSIYRASSLSNCRHTSSVEE

SEQ ID NO: 1141 - protein, 42 aa, Artificial Sequence
  chemically synthesized
SQVSPFKIPIEDLEDRVFVNCNTTIYRASSLSNCRHTSSVEE

SEQ ID NO: 1142 - protein, 42 aa, Artificial Sequence
  chemically synthesized
SQVSPFKIPIEDLEDRVFVNCNTYIYRASSLSNCRHTSSVEE

SEQ ID NO: 1143 - protein, 42 aa, Artificial Sequence
  chemically synthesized
SQVSPFKIPIEDLEDRVFVNCNTSVYRASSLSNCRHTSSVEE

SEQ ID NO: 1144 - protein, 42 aa, Artificial Sequence
  chemically synthesized
SQVSPFKIPIEDLEDRVFVNCNTSLYRASSLSNCRHTSSVEE

SEQ ID NO: 1145 - protein, 42 aa, Artificial Sequence
  chemically synthesized
SQVSPFKIPIEDLEDRVFVNCNTSHYRASSLSNCRHTSSVEE

SEQ ID NO: 1146 - protein, 42 aa, Artificial Sequence
  chemically synthesized
SQVSPFKIPIEDLEDRVFVNCNTSFYRASSLSNCRHTSSVEE

SEQ ID NO: 1147 - protein, 42 aa, Artificial Sequence
  chemically synthesized
SQVSPFKIPIEDLEDRVFVNCNTSMYRASSLSNCRHTSSVEE

SEQ ID NO: 1148 - protein, 42 aa, Artificial Sequence
  chemically synthesized
SQVSPFKIPIEDLEDRVFVNCNTSIWRASSLSNCRHTSSVEE

SEQ ID NO: 1149 - protein, 42 aa, Artificial Sequence
  chemically synthesized
SQVSPFKIPIEDLEDRVFVNCNTSIFRASSLSNCRHTSSVEE

SEQ ID NO: 1150 - protein, 42 aa, Artificial Sequence
  chemically synthesized
SQVSPFKIPIEDLEDRVFVNCNTSISRASSLSNCRHTSSVEE

SEQ ID NO: 1151 - protein, 42 aa, Artificial Sequence
  chemically synthesized
SQVSPFKIPIEDLEDRVFVNCNTSITRASSLSNCRHTSSVEE

SEQ ID NO: 1152 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEDLEDRVFVNCNTSIYXASSLSNCRHTSSVEE

SEQ ID NO: 1153 - protein, 42 aa, Artificial Sequence
  chemically synthesized
SQVSPFKIPIEDLEDRVFVNCNTSIYHASSLSNCRHTSSVEE

SEQ ID NO: 1154 - protein, 42 aa, Artificial Sequence
  chemically synthesized
SQVSPFKIPIEDLEDRVFVNCNTSIYKASSLSNCRHTSSVEE

SEQ ID NO: 1155 - protein, 42 aa, Artificial Sequence
  chemically synthesized
SQVSPFKIPIEDLEDRVFVNCNTSIYRGSSLSNCRHTSSVEE

SEQ ID NO: 1156 - protein, 42 aa, Artificial Sequence
  chemically synthesized
SQVSPFKIPIEDLEDRVFVNCNTSIYRATSLSNCRHTSSVEE

SEQ ID NO: 1157 - protein, 42 aa, Artificial Sequence
  chemically synthesized
SQVSPFKIPIEDLEDRVFVNCNTSIYRAYSLSNCRHTSSVEE

SEQ ID NO: 1158 - protein, 42 aa, Artificial Sequence
  chemically synthesized
SQVSPFKIPIEDLEDRVFVNCNTSIYRASTLSNCRHTSSVEE

SEQ ID NO: 1159 - protein, 42 aa, Artificial Sequence
  chemically synthesized
SQVSPFKIPIEDLEDRVFVNCNTSIYRASYLSNCRHTSSVEE

SEQ ID NO: 1160 - protein, 42 aa, Artificial Sequence
  chemically synthesized
SQVSPFKIPIEDLEDRVFVNCNTSIYRASSISNCRHTSSVEE

SEQ ID NO: 1161 - protein, 42 aa, Artificial Sequence
  chemically synthesized
SQVSPFKIPIEDLEDRVFVNCNTSIYRASSVSNCRHTSSVEE

SEQ ID NO: 1162 - protein, 42 aa, Artificial Sequence
  chemically synthesized
SQVSPFKIPIEDLEDRVFVNCNTSIYRASSFSNCRHTSSVEE

SEQ ID NO: 1163 - protein, 42 aa, Artificial Sequence
  chemically synthesized
SQVSPFKIPIEDLEDRVFVNCNTSIYRASSMSNCRHTSSVEE

SEQ ID NO: 1164 - protein, 42 aa, Artificial Sequence
  chemically synthesized
SQVSPFKIPIEDLEDRVFVNCNTSIYRASSHSNCRHTSSVEE

SEQ ID NO: 1165 - protein, 42 aa, Artificial Sequence
  chemically synthesized
SQVSPFKIPIEDLEDRVFVNCNTSIYRASSLTNCRHTSSVEE

SEQ ID NO: 1166 - protein, 42 aa, Artificial Sequence
  chemically synthesized
SQVSPFKIPIEDLEDRVFVNCNTSIYRASSLYNCRHTSSVEE

SEQ ID NO: 1167 - protein, 42 aa, Artificial Sequence
  chemically synthesized
SQVSPFKIPIEDLEDRVFVNCNTSIYRASSLSQCRHTSSVEE

SEQ ID NO: 1168 - protein, 42 aa, Artificial Sequence
  chemically synthesized
SQVSPFKIPIEDLEDRVFVNCNTSIYRASSLSNSRHTSSVEE

SEQ ID NO: 1169 - protein, 42 aa, Artificial Sequence
  chemically synthesized
SQVSPFKIPIEDLEDRVFVNCNTSIYRASSLSNGRHTSSVEE

SEQ ID NO: 1170 - protein, 42 aa, Artificial Sequence
  chemically synthesized
SQVSPFKIPIEDLEDRVFVNCNTSIYRASSLSNARHTSSVEE

SEQ ID NO: 1171 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEDLEDRVFVNCNTSIYRASSLSNCXHTSSVEE

SEQ ID NO: 1172 - protein, 42 aa, Artificial Sequence
  chemically synthesized
SQVSPFKIPIEDLEDRVFVNCNTSIYRASSLSNCHHTSSVEE

SEQ ID NO: 1173 - protein, 42 aa, Artificial Sequence
  chemically synthesized
SQVSPFKIPIEDLEDRVFVNCNTSIYRASSLSNCKHTSSVEE

SEQ ID NO: 1174 - protein, 42 aa, Artificial Sequence
  chemically synthesized
SQVSPFKIPIEDLEDRVFVNCNTSIYRASSLSNCRGTSSVEE

SEQ ID NO: 1175 - protein, 42 aa, Artificial Sequence
  chemically synthesized
SQVSPFKIPIEDLEDRVFVNCNTSIYRASSLSNCRATSSVEE

SEQ ID NO: 1176 - protein, 42 aa, Artificial Sequence
  chemically synthesized
SQVSPFKIPIEDLEDRVFVNCNTSIYRASSLSNCRITSSVEE

SEQ ID NO: 1177 - protein, 42 aa, Artificial Sequence
  chemically synthesized
SQVSPFKIPIEDLEDRVFVNCNTSIYRASSLSNCRLTSSVEE

SEQ ID NO: 1178 - protein, 42 aa, Artificial Sequence
  chemically synthesized
SQVSPFKIPIEDLEDRVFVNCNTSIYRASSLSNCRMTSSVEE

SEQ ID NO: 1179 - protein, 42 aa, Artificial Sequence
  chemically synthesized
SQVSPFKIPIEDLEDRVFVNCNTSIYRASSLSNCRVTSSVEE

SEQ ID NO: 1180 - protein, 42 aa, Artificial Sequence
  chemically synthesized
SQVSPFKIPIEDLEDRVFVNCNTSIYRASSLSNCRHSSSVEE

SEQ ID NO: 1181 - protein, 42 aa, Artificial Sequence
  chemically synthesized
SQVSPFKIPIEDLEDRVFVNCNTSIYRASSLSNCRHYSSVEE

SEQ ID NO: 1182 - protein, 42 aa, Artificial Sequence
  chemically synthesized
SQVSPFKIPIEDLEDRVFVNCNTSIYRASSLSNCRHTTSVEE

SEQ ID NO: 1183 - protein, 42 aa, Artificial Sequence
  chemically synthesized
SQVSPFKIPIEDLEDRVFVNCNTSIYRASSLSNCRHTYSVEE

SEQ ID NO: 1184 - protein, 42 aa, Artificial Sequence
  chemically synthesized
SQVSPFKIPIEDLEDRVFVNCNTSIYRASSLSNCRHTSTVEE

SEQ ID NO: 1185 - protein, 42 aa, Artificial Sequence
  chemically synthesized
SQVSPFKIPIEDLEDRVFVNCNTSIYRASSLSNCRHTSYVEE

SEQ ID NO: 1186 - protein, 42 aa, Artificial Sequence
  chemically synthesized
SQVSPFKIPIEDLEDRVFVNCNTSIYRASSLSNCRHTSSIEE

SEQ ID NO: 1187 - protein, 42 aa, Artificial Sequence
  chemically synthesized
SQVSPFKIPIEDLEDRVFVNCNTSIYRASSLSNCRHTSSLEE

SEQ ID NO: 1188 - protein, 42 aa, Artificial Sequence
  chemically synthesized
SQVSPFKIPIEDLEDRVFVNCNTSIYRASSLSNCRHTSSFEE

SEQ ID NO: 1189 - protein, 42 aa, Artificial Sequence
  chemically synthesized
SQVSPFKIPIEDLEDRVFVNCNTSIYRASSLSNCRHTSSHEE

SEQ ID NO: 1190 - protein, 42 aa, Artificial Sequence
  chemically synthesized
SQVSPFKIPIEDLEDRVFVNCNTSIYRASSLSNCRHTSSMEE

SEQ ID NO: 1191 - protein, 42 aa, Artificial Sequence
  chemically synthesized
SQVSPFKIPIEDLEDRVFVNCNTSIYRASSLSNCRHTSSVDE

SEQ ID NO: 1192 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEDLEDRVFVNCNTSIYRASSLSNCRHTSSVXE

SEQ ID NO: 1193 - protein, 42 aa, Artificial Sequence
  chemically synthesized
SQVSPFKIPIEDLEDRVFVNCNTSIYRASSLSNCRHTSSVED

SEQ ID NO: 1194 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEDLEDRVFVNCNTSIYRASSLSNCRHTSSVEX

SEQ ID NO: 1195 - protein, 42 aa, Artificial Sequence
  chemically synthesized
SQVSAFKIPIEDLEDRVFVNCNTSIYRASSLSNCRHTSSVEE

SEQ ID NO: 1196 - protein, 42 aa, Artificial Sequence
  chemically synthesized
SQVSGFKIPIEDLEDRVFVNCNTSIYRASSLSNCRHTSSVEE

SEQ ID NO: 1197 - protein, 42 aa, Artificial Sequence
  chemically synthesized
SQVSPFKIAIEDLEDRVFVNCNTSIYRASSLSNCRHTSSVEE

SEQ ID NO: 1198 - protein, 42 aa, Artificial Sequence
  chemically synthesized
SQVSPFKIGIEDLEDRVFVNCNTSIYRASSLSNCRHTSSVEE

SEQ ID NO: 1199 - protein, 42 aa, Artificial Sequence; identical to SEQ ID NO: 35
  chemically synthesized

SEQ ID NO: 1200 - protein, 42 aa, Artificial Sequence; identical to SEQ ID NO: 154
  chemically synthesized

SEQ ID NO: 1201 - protein, 42 aa, Artificial Sequence
  chemically synthesized
YQVSPFKIPIEEIEDRVFVNCNTSIYRASSLSNCRHTSSVEE

SEQ ID NO: 1202 - protein, 42 aa, Artificial Sequence; identical to SEQ ID NO: 274
  chemically synthesized

SEQ ID NO: 1203 - protein, 42 aa, Artificial Sequence; identical to SEQ ID NO: 392
  chemically synthesized

SEQ ID NO: 1204 - protein, 42 aa, Artificial Sequence
  chemically synthesized
SQISPFKIPIEEIEDRVFVNCNTSIYRASSLSNCRHTSSVEE

SEQ ID NO: 1205 - protein, 42 aa, Artificial Sequence
  chemically synthesized
SQPSPFKIPIEEIEDRVFVNCNTSIYRASSLSNCRHTSSVEE

SEQ ID NO: 1206 - protein, 42 aa, Artificial Sequence
  chemically synthesized
SQFSPFKIPIEEIEDRVFVNCNTSIYRASSLSNCRHTSSVEE

SEQ ID NO: 1207 - protein, 42 aa, Artificial Sequence; identical to SEQ ID NO: 511
  chemically synthesized

SEQ ID NO: 1208 - protein, 42 aa, Artificial Sequence
  chemically synthesized
SQVYPFKIPIEEIEDRVFVNCNTSIYRASSLSNCRHTSSVEE

SEQ ID NO: 1209 - protein, 42 aa, Artificial Sequence
  chemically synthesized
SQVSPWKIPIEEIEDRVFVNCNTSIYRASSLSNCRHTSSVEE

SEQ ID NO: 1210 - protein, 42 aa, Artificial Sequence
  chemically synthesized
SQVSPYKIPIEEIEDRVFVNCNTSIYRASSLSNCRHTSSVEE

SEQ ID NO: 1211 - protein, 42 aa, Artificial Sequence
  chemically synthesized
SQVSPHKIPIEEIEDRVFVNCNTSIYRASSLSNCRHTSSVEE

SEQ ID NO: 1212 - protein, 42 aa, Artificial Sequence
  chemically synthesized
SQVSPFRIPIEEIEDRVFVNCNTSIYRASSLSNCRHTSSVEE

SEQ ID NO: 1213 - protein, 42 aa, Artificial Sequence
  chemically synthesized
SQVSPFHIPIEEIEDRVFVNCNTSIYRASSLSNCRHTSSVEE

SEQ ID NO: 1214 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEEIEDRVFVNCNTSIYRASSLSNCRHTSSVEE

SEQ ID NO: 1215 - protein, 42 aa, Artificial Sequence; identical to SEQ ID NO: 750
  chemically synthesized

SEQ ID NO: 1216 - protein, 42 aa, Artificial Sequence
  chemically synthesized
SQVSPFKHPIEEIEDRVFVNCNTSIYRASSLSNCRHTSSVEE

SEQ ID NO: 1217 - protein, 42 aa, Artificial Sequence
  chemically synthesized
SQVSPFKVPIEEIEDRVFVNCNTSIYRASSLSNCRHTSSVEE

SEQ ID NO: 1218 - protein, 42 aa, Artificial Sequence
  chemically synthesized
SQVSPFKFPIEEIEDRVFVNCNTSIYRASSLSNCRHTSSVEE

SEQ ID NO: 1219 - protein, 42 aa, Artificial Sequence
  chemically synthesized
SQVSPFKMPIEEIEDRVFVNCNTSIYRASSLSNCRHTSSVEE

SEQ ID NO: 1220 - protein, 42 aa, Artificial Sequence; identical to SEQ ID NO: 868
  chemically synthesized

SEQ ID NO: 1221 - protein, 42 aa, Artificial Sequence
  chemically synthesized
SQVSPFKIPHEEIEDRVFVNCNTSIYRASSLSNCRHTSSVEE

SEQ ID NO: 1222 - protein, 42 aa, Artificial Sequence
  chemically synthesized
SQVSPFKIPVEEIEDRVFVNCNTSIYRASSLSNCRHTSSVEE

SEQ ID NO: 1223 - protein, 42 aa, Artificial Sequence
  chemically synthesized
SQVSPFKIPFEEIEDRVFVNCNTSIYRASSLSNCRHTSSVEE

SEQ ID NO: 1224 - protein, 42 aa, Artificial Sequence
  chemically synthesized
SQVSPFKIPMEEIEDRVFVNCNTSIYRASSLSNCRHTSSVEE

SEQ ID NO: 1225 - protein, 42 aa, Artificial Sequence; identical to SEQ ID NO: 988
  chemically synthesized

SEQ ID NO: 1226 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXEIEDRVFVNCNTSIYRASSLSNCRHTSSVEE

SEQ ID NO: 1227 - protein, 42 aa, Artificial Sequence; identical to SEQ ID NO: 1108
  chemically synthesized

SEQ ID NO: 1228 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXIEDRVFVNCNTSIYRASSLSNCRHTSSVEE

SEQ ID NO: 1229 - protein, 42 aa, Artificial Sequence
  chemically synthesized
SQVSPFKIPIEEIDDRVFVNCNTSIYRASSLSNCRHTSSVEE

SEQ ID NO: 1230 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEEIXDRVFVNCNTSIYRASSLSNCRHTSSVEE

SEQ ID NO: 1231 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEEIEXRVFVNCNTSIYRASSLSNCRHTSSVEE

SEQ ID NO: 1232 - protein, 42 aa, Artificial Sequence
  chemically synthesized
SQVSPFKIPIEEIEERVFVNCNTSIYRASSLSNCRHTSSVEE

SEQ ID NO: 1233 - protein, 42 aa, Artificial Sequence
  chemically synthesized
SQVSPFKIPIEEIEDKVFVNCNTSIYRASSLSNCRHTSSVEE

SEQ ID NO: 1234 - protein, 42 aa, Artificial Sequence
  chemically synthesized
SQVSPFKIPIEEIEDHVFVNCNTSIYRASSLSNCRHTSSVEE

SEQ ID NO: 1235 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEEIEDXVFVNCNTSIYRASSLSNCRHTSSVEE

SEQ ID NO: 1236 - protein, 42 aa, Artificial Sequence
  chemically synthesized
SQVSPFKIPIEEIEDRIFVNCNTSIYRASSLSNCRHTSSVEE

SEQ ID NO: 1237 - protein, 42 aa, Artificial Sequence
  chemically synthesized
SQVSPFKIPIEEIEDRLFVNCNTSIYRASSLSNCRHTSSVEE

SEQ ID NO: 1238 - protein, 42 aa, Artificial Sequence
  chemically synthesized
SQVSPFKIPIEEIEDRFFVNCNTSIYRASSLSNCRHTSSVEE

SEQ ID NO: 1239 - protein, 42 aa, Artificial Sequence
  chemically synthesized
SQVSPFKIPIEEIEDRHFVNCNTSIYRASSLSNCRHTSSVEE

SEQ ID NO: 1240 - protein, 42 aa, Artificial Sequence
  chemically synthesized
SQVSPFKIPIEEIEDRMFVNCNTSIYRASSLSNCRHTSSVEE

SEQ ID NO: 1241 - protein, 42 aa, Artificial Sequence
  chemically synthesized
SQVSPFKIPIEEIEDRVIVNCNTSIYRASSLSNCRHTSSVEE

SEQ ID NO: 1242 - protein, 42 aa, Artificial Sequence
  chemically synthesized
SQVSPFKIPIEEIEDRVLVNCNTSIYRASSLSNCRHTSSVEE

SEQ ID NO: 1243 - protein, 42 aa, Artificial Sequence
  chemically synthesized
SQVSPFKIPIEEIEDRVVVNCNTSIYRASSLSNCRHTSSVEE

SEQ ID NO: 1244 - protein, 42 aa, Artificial Sequence
  chemically synthesized
SQVSPFKIPIEEIEDRVHVNCNTSIYRASSLSNCRHTSSVEE

SEQ ID NO: 1245 - protein, 42 aa, Artificial Sequence
  chemically synthesized
SQVSPFKIPIEEIEDRVMVNCNTSIYRASSLSNCRHTSSVEE

SEQ ID NO: 1246 - protein, 42 aa, Artificial Sequence
  chemically synthesized
SQVSPFKIPIEEIEDRVFINCNTSIYRASSLSNCRHTSSVEE

SEQ ID NO: 1247 - protein, 42 aa, Artificial Sequence
  chemically synthesized
SQVSPFKIPIEEIEDRVFLNCNTSIYRASSLSNCRHTSSVEE

SEQ ID NO: 1248 - protein, 42 aa, Artificial Sequence
  chemically synthesized
SQVSPFKIPIEEIEDRVFFNCNTSIYRASSLSNCRHTSSVEE

SEQ ID NO: 1249 - protein, 42 aa, Artificial Sequence
  chemically synthesized
SQVSPFKIPIEEIEDRVFHNCNTSIYRASSLSNCRHTSSVEE

SEQ ID NO: 1250 - protein, 42 aa, Artificial Sequence
  chemically synthesized
SQVSPFKIPIEEIEDRVFMNCNTSIYRASSLSNCRHTSSVEE

SEQ ID NO: 1251 - protein, 42 aa, Artificial Sequence
  chemically synthesized
SQVSPFKIPIEEIEDRVFVQCNTSIYRASSLSNCRHTSSVEE

SEQ ID NO: 1252 - protein, 42 aa, Artificial Sequence
  chemically synthesized
SQVSPFKIPIEEIEDRVFVNSNTSIYRASSLSNCRHTSSVEE

SEQ ID NO: 1253 - protein, 42 aa, Artificial Sequence
  chemically synthesized
SQVSPFKIPIEEIEDRVFVNGNTSIYRASSLSNCRHTSSVEE

SEQ ID NO: 1254 - protein, 42 aa, Artificial Sequence
  chemically synthesized
SQVSPFKIPIEEIEDRVFVNANTSIYRASSLSNCRHTSSVEE

SEQ ID NO: 1255 - protein, 42 aa, Artificial Sequence
  chemically synthesized
SQVSPFKIPIEEIEDRVFVNCQTSIYRASSLSNCRHTSSVEE

SEQ ID NO: 1256 - protein, 42 aa, Artificial Sequence
  chemically synthesized
SQVSPFKIPIEEIEDRVFVNCNSSIYRASSLSNCRHTSSVEE

SEQ ID NO: 1257 - protein, 42 aa, Artificial Sequence
  chemically synthesized
SQVSPFKIPIEEIEDRVFVNCNYSIYRASSLSNCRHTSSVEE

SEQ ID NO: 1258 - protein, 42 aa, Artificial Sequence
  chemically synthesized
SQVSPFKIPIEEIEDRVFVNCNTTIYRASSLSNCRHTSSVEE

SEQ ID NO: 1259 - protein, 42 aa, Artificial Sequence
  chemically synthesized
SQVSPFKIPIEEIEDRVFVNCNTYIYRASSLSNCRHTSSVEE

SEQ ID NO: 1260 - protein, 42 aa, Artificial Sequence
  chemically synthesized
SQVSPFKIPIEEIEDRVFVNCNTSVYRASSLSNCRHTSSVEE

SEQ ID NO: 1261 - protein, 42 aa, Artificial Sequence
  chemically synthesized
SQVSPFKIPIEEIEDRVFVNCNTSLYRASSLSNCRHTSSVEE

SEQ ID NO: 1262 - protein, 42 aa, Artificial Sequence
  chemically synthesized
SQVSPFKIPIEEIEDRVFVNCNTSHYRASSLSNCRHTSSVEE

SEQ ID NO: 1263 - protein, 42 aa, Artificial Sequence
  chemically synthesized
SQVSPFKIPIEEIEDRVFVNCNTSFYRASSLSNCRHTSSVEE

SEQ ID NO: 1264 - protein, 42 aa, Artificial Sequence
  chemically synthesized
SQVSPFKIPIEEIEDRVFVNCNTSMYRASSLSNCRHTSSVEE

SEQ ID NO: 1265 - protein, 42 aa, Artificial Sequence
  chemically synthesized
SQVSPFKIPIEEIEDRVFVNCNTSIWRASSLSNCRHTSSVEE

SEQ ID NO: 1266 - protein, 42 aa, Artificial Sequence
  chemically synthesized
SQVSPFKIPIEEIEDRVFVNCNTSIFRASSLSNCRHTSSVEE

SEQ ID NO: 1267 - protein, 42 aa, Artificial Sequence
  chemically synthesized
SQVSPFKIPIEEIEDRVFVNCNTSISRASSLSNCRHTSSVEE

SEQ ID NO: 1268 - protein, 42 aa, Artificial Sequence
  chemically synthesized
SQVSPFKIPIEEIEDRVFVNCNTSITRASSLSNCRHTSSVEE

SEQ ID NO: 1269 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEEIEDRVFVNCNTSIYXASSLSNCRHTSSVEE

SEQ ID NO: 1270 - protein, 42 aa, Artificial Sequence
  chemically synthesized
SQVSPFKIPIEEIEDRVFVNCNTSIYHASSLSNCRHTSSVEE

SEQ ID NO: 1271 - protein, 42 aa, Artificial Sequence
  chemically synthesized
SQVSPFKIPIEEIEDRVFVNCNTSIYKASSLSNCRHTSSVEE

SEQ ID NO: 1272 - protein, 42 aa, Artificial Sequence
  chemically synthesized
SQVSPFKIPIEEIEDRVFVNCNTSIYRGSSLSNCRHTSSVEE

SEQ ID NO: 1273 - protein, 42 aa, Artificial Sequence
  chemically synthesized
SQVSPFKIPIEEIEDRVFVNCNTSIYRATSLSNCRHTSSVEE

SEQ ID NO: 1274 - protein, 42 aa, Artificial Sequence
  chemically synthesized
SQVSPFKIPIEEIEDRVFVNCNTSIYRAYSLSNCRHTSSVEE

SEQ ID NO: 1275 - protein, 42 aa, Artificial Sequence
  chemically synthesized
SQVSPFKIPIEEIEDRVFVNCNTSIYRASTLSNCRHTSSVEE

SEQ ID NO: 1276 - protein, 42 aa, Artificial Sequence
  chemically synthesized
SQVSPFKIPIEEIEDRVFVNCNTSIYRASYLSNCRHTSSVEE

SEQ ID NO: 1277 - protein, 42 aa, Artificial Sequence
  chemically synthesized
SQVSPFKIPIEEIEDRVFVNCNTSIYRASSISNCRHTSSVEE

SEQ ID NO: 1278 - protein, 42 aa, Artificial Sequence
  chemically synthesized
SQVSPFKIPIEEIEDRVFVNCNTSIYRASSVSNCRHTSSVEE

SEQ ID NO: 1279 - protein, 42 aa, Artificial Sequence
  chemically synthesized
SQVSPFKIPIEEIEDRVFVNCNTSIYRASSFSNCRHTSSVEE

SEQ ID NO: 1280 - protein, 42 aa, Artificial Sequence
  chemically synthesized
SQVSPFKIPIEEIEDRVFVNCNTSIYRASSMSNCRHTSSVEE

SEQ ID NO: 1281 - protein, 42 aa, Artificial Sequence
  chemically synthesized
SQVSPFKIPIEEIEDRVFVNCNTSIYRASSHSNCRHTSSVEE

SEQ ID NO: 1282 - protein, 42 aa, Artificial Sequence
  chemically synthesized
SQVSPFKIPIEEIEDRVFVNCNTSIYRASSLTNCRHTSSVEE

SEQ ID NO: 1283 - protein, 42 aa, Artificial Sequence
  chemically synthesized
SQVSPFKIPIEEIEDRVFVNCNTSIYRASSLYNCRHTSSVEE

SEQ ID NO: 1284 - protein, 42 aa, Artificial Sequence
  chemically synthesized
SQVSPFKIPIEEIEDRVFVNCNTSIYRASSLSQCRHTSSVEE

SEQ ID NO: 1285 - protein, 42 aa, Artificial Sequence
  chemically synthesized
SQVSPFKIPIEEIEDRVFVNCNTSIYRASSLSNSRHTSSVEE

SEQ ID NO: 1286 - protein, 42 aa, Artificial Sequence
  chemically synthesized
SQVSPFKIPIEEIEDRVFVNCNTSIYRASSLSNGRHTSSVEE

SEQ ID NO: 1287 - protein, 42 aa, Artificial Sequence
  chemically synthesized
SQVSPFKIPIEEIEDRVFVNCNTSIYRASSLSNARHTSSVEE

SEQ ID NO: 1288 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEEIEDRVFVNCNTSIYRASSLSNCXHTSSVEE

SEQ ID NO: 1289 - protein, 42 aa, Artificial Sequence
  chemically synthesized
SQVSPFKIPIEEIEDRVFVNCNTSIYRASSLSNCHHTSSVEE

SEQ ID NO: 1290 - protein, 42 aa, Artificial Sequence
  chemically synthesized
SQVSPFKIPIEEIEDRVFVNCNTSIYRASSLSNCKHTSSVEE

SEQ ID NO: 1291 - protein, 42 aa, Artificial Sequence
  chemically synthesized
SQVSPFKIPIEEIEDRVFVNCNTSIYRASSLSNCRGTSSVEE

SEQ ID NO: 1292 - protein, 42 aa, Artificial Sequence
  chemically synthesized
SQVSPFKIPIEEIEDRVFVNCNTSIYRASSLSNCRATSSVEE

SEQ ID NO: 1293 - protein, 42 aa, Artificial Sequence
  chemically synthesized
SQVSPFKIPIEEIEDRVFVNCNTSIYRASSLSNCRITSSVEE

SEQ ID NO: 1294 - protein, 42 aa, Artificial Sequence
  chemically synthesized
SQVSPFKIPIEEIEDRVFVNCNTSIYRASSLSNCRLTSSVEE

SEQ ID NO: 1295 - protein, 42 aa, Artificial Sequence
  chemically synthesized
SQVSPFKIPIEEIEDRVFVNCNTSIYRASSLSNCRMTSSVEE

SEQ ID NO: 1296 - protein, 42 aa, Artificial Sequence
  chemically synthesized
SQVSPFKIPIEEIEDRVFVNCNTSIYRASSLSNCRVTSSVEE

SEQ ID NO: 1297 - protein, 42 aa, Artificial Sequence
  chemically synthesized
SQVSPFKIPIEEIEDRVFVNCNTSIYRASSLSNCRHSSSVEE

SEQ ID NO: 1298 - protein, 42 aa, Artificial Sequence
  chemically synthesized
SQVSPFKIPIEEIEDRVFVNCNTSIYRASSLSNCRHYSSVEE

SEQ ID NO: 1299 - protein, 42 aa, Artificial Sequence
  chemically synthesized
SQVSPFKIPIEEIEDRVFVNCNTSIYRASSLSNCRHTTSVEE

SEQ ID NO: 1300 - protein, 42 aa, Artificial Sequence
  chemically synthesized
SQVSPFKIPIEEIEDRVFVNCNTSIYRASSLSNCRHTYSVEE

SEQ ID NO: 1301 - protein, 42 aa, Artificial Sequence
  chemically synthesized
SQVSPFKIPIEEIEDRVFVNCNTSIYRASSLSNCRHTSTVEE

SEQ ID NO: 1302 - protein, 42 aa, Artificial Sequence
  chemically synthesized
SQVSPFKIPIEEIEDRVFVNCNTSIYRASSLSNCRHTSYVEE

SEQ ID NO: 1303 - protein, 42 aa, Artificial Sequence
  chemically synthesized
SQVSPFKIPIEEIEDRVFVNCNTSIYRASSLSNCRHTSSIEE

SEQ ID NO: 1304 - protein, 42 aa, Artificial Sequence
  chemically synthesized
SQVSPFKIPIEEIEDRVFVNCNTSIYRASSLSNCRHTSSLEE

SEQ ID NO: 1305 - protein, 42 aa, Artificial Sequence
  chemically synthesized
SQVSPFKIPIEEIEDRVFVNCNTSIYRASSLSNCRHTSSFEE

SEQ ID NO: 1306 - protein, 42 aa, Artificial Sequence
  chemically synthesized
SQVSPFKIPIEEIEDRVFVNCNTSIYRASSLSNCRHTSSHEE

SEQ ID NO: 1307 - protein, 42 aa, Artificial Sequence
  chemically synthesized
SQVSPFKIPIEEIEDRVFVNCNTSIYRASSLSNCRHTSSMEE

SEQ ID NO: 1308 - protein, 42 aa, Artificial Sequence
  chemically synthesized
SQVSPFKIPIEEIEDRVFVNCNTSIYRASSLSNCRHTSSVDE

SEQ ID NO: 1309 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEEIEDRVFVNCNTSIYRASSLSNCRHTSSVXE

SEQ ID NO: 1310 - protein, 42 aa, Artificial Sequence
  chemically synthesized
SQVSPFKIPIEEIEDRVFVNCNTSIYRASSLSNCRHTSSVED

SEQ ID NO: 1311 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEEIEDRVFVNCNTSIYRASSLSNCRHTSSVEX

SEQ ID NO: 1312 - protein, 42 aa, Artificial Sequence
  chemically synthesized
SQVSAFKIPIEEIEDRVFVNCNTSIYRASSLSNCRHTSSVEE

SEQ ID NO: 1313 - protein, 42 aa, Artificial Sequence
  chemically synthesized
SQVSGFKIPIEEIEDRVFVNCNTSIYRASSLSNCRHTSSVEE

SEQ ID NO: 1314 - protein, 42 aa, Artificial Sequence
  chemically synthesized
SQVSPFKIAIEEIEDRVFVNCNTSIYRASSLSNCRHTSSVEE

SEQ ID NO: 1315 - protein, 42 aa, Artificial Sequence
  chemically synthesized
SQVSPFKIGIEEIEDRVFVNCNTSIYRASSLSNCRHTSSVEE

SEQ ID NO: 1316 - protein, 42 aa, Artificial Sequence; identical to SEQ ID NO: 39
  chemically synthesized

SEQ ID NO: 1317 - protein, 42 aa, Artificial Sequence; identical to SEQ ID NO: 158
  chemically synthesized

SEQ ID NO: 1318 - protein, 42 aa, Artificial Sequence
  chemically synthesized
YQVSPFKIPIEELDDRVFVNCNTSIYRASSLSNCRHTSSVEE

SEQ ID NO: 1319 - protein, 42 aa, Artificial Sequence; identical to SEQ ID NO: 278
  chemically synthesized

SEQ ID NO: 1320 - protein, 42 aa, Artificial Sequence; identical to SEQ ID NO: 396
  chemically synthesized

SEQ ID NO: 1321 - protein, 42 aa, Artificial Sequence
  chemically synthesized
SQISPFKIPIEELDDRVFVNCNTSIYRASSLSNCRHTSSVEE

SEQ ID NO: 1322 - protein, 42 aa, Artificial Sequence
  chemically synthesized
SQPSPFKIPIEELDDRVFVNCNTSIYRASSLSNCRHTSSVEE

SEQ ID NO: 1323 - protein, 42 aa, Artificial Sequence
  chemically synthesized
SQFSPFKIPIEELDDRVFVNCNTSIYRASSLSNCRHTSSVEE

SEQ ID NO: 1324 - protein, 42 aa, Artificial Sequence; identical to SEQ ID NO: 515
  chemically synthesized

SEQ ID NO: 1325 - protein, 42 aa, Artificial Sequence
  chemically synthesized
SQVYPFKIPIEELDDRVFVNCNTSIYRASSLSNCRHTSSVEE

SEQ ID NO: 1326 - protein, 42 aa, Artificial Sequence
  chemically synthesized
SQVSPWKIPIEELDDRVFVNCNTSIYRASSLSNCRHTSSVEE

SEQ ID NO: 1327 - protein, 42 aa, Artificial Sequence
  chemically synthesized
SQVSPYKIPIEELDDRVFVNCNTSIYRASSLSNCRHTSSVEE

SEQ ID NO: 1328 - protein, 42 aa, Artificial Sequence
  chemically synthesized
SQVSPHKIPIEELDDRVFVNCNTSIYRASSLSNCRHTSSVEE

SEQ ID NO: 1329 - protein, 42 aa, Artificial Sequence
  chemically synthesized
SQVSPFRIPIEELDDRVFVNCNTSIYRASSLSNCRHTSSVEE

SEQ ID NO: 1330 - protein, 42 aa, Artificial Sequence
  chemically synthesized
SQVSPFHIPIEELDDRVFVNCNTSIYRASSLSNCRHTSSVEE

SEQ ID NO: 1331 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELDDRVFVNCNTSIYRASSLSNCRHTSSVEE

SEQ ID NO: 1332 - protein, 42 aa, Artificial Sequence; identical to SEQ ID NO: 754
  chemically synthesized

SEQ ID NO: 1333 - protein, 42 aa, Artificial Sequence
  chemically synthesized
SQVSPFKHPIEELDDRVFVNCNTSIYRASSLSNCRHTSSVEE

SEQ ID NO: 1334 - protein, 42 aa, Artificial Sequence
  chemically synthesized
SQVSPFKVPIEELDDRVFVNCNTSIYRASSLSNCRHTSSVEE

SEQ ID NO: 1335 - protein, 42 aa, Artificial Sequence
  chemically synthesized
SQVSPFKFPIEELDDRVFVNCNTSIYRASSLSNCRHTSSVEE

SEQ ID NO: 1336 - protein, 42 aa, Artificial Sequence
  chemically synthesized
SQVSPFKMPIEELDDRVFVNCNTSIYRASSLSNCRHTSSVEE

SEQ ID NO: 1337 - protein, 42 aa, Artificial Sequence; identical to SEQ ID NO: 872
  chemically synthesized

SEQ ID NO: 1338 - protein, 42 aa, Artificial Sequence
  chemically synthesized
SQVSPFKIPHEELDDRVFVNCNTSIYRASSLSNCRHTSSVEE

SEQ ID NO: 1339 - protein, 42 aa, Artificial Sequence
  chemically synthesized
SQVSPFKIPVEELDDRVFVNCNTSIYRASSLSNCRHTSSVEE

SEQ ID NO: 1340 - protein, 42 aa, Artificial Sequence
  chemically synthesized
SQVSPFKIPFEELDDRVFVNCNTSIYRASSLSNCRHTSSVEE

SEQ ID NO: 1341 - protein, 42 aa, Artificial Sequence
  chemically synthesized
SQVSPFKIPMEELDDRVFVNCNTSIYRASSLSNCRHTSSVEE

SEQ ID NO: 1342 - protein, 42 aa, Artificial Sequence; identical to SEQ ID NO: 992
  chemically synthesized

SEQ ID NO: 1343 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELDDRVFVNCNTSIYRASSLSNCRHTSSVEE

SEQ ID NO: 1344 - protein, 42 aa, Artificial Sequence; identical to SEQ ID NO: 1112
  chemically synthesized

SEQ ID NO: 1345 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLDDRVFVNCNTSIYRASSLSNCRHTSSVEE

SEQ ID NO: 1346 - protein, 42 aa, Artificial Sequence
  chemically synthesized
SQVSPFKIPIEEVDDRVFVNCNTSIYRASSLSNCRHTSSVEE

SEQ ID NO: 1347 - protein, 42 aa, Artificial Sequence; identical to SEQ ID NO: 1229
  chemically synthesized

SEQ ID NO: 1348 - protein, 42 aa, Artificial Sequence
  chemically synthesized
SQVSPFKIPIEEFDDRVFVNCNTSIYRASSLSNCRHTSSVEE

SEQ ID NO: 1349 - protein, 42 aa, Artificial Sequence
  chemically synthesized
SQVSPFKIPIEEHDDRVFVNCNTSIYRASSLSNCRHTSSVEE

SEQ ID NO: 1350 - protein, 42 aa, Artificial Sequence
  chemically synthesized
SQVSPFKIPIEEMDDRVFVNCNTSIYRASSLSNCRHTSSVEE

SEQ ID NO: 1351 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELDXRVFVNCNTSIYRASSLSNCRHTSSVEE

SEQ ID NO: 1352 - protein, 42 aa, Artificial Sequence
  chemically synthesized
SQVSPFKIPIEELDERVFVNCNTSIYRASSLSNCRHTSSVEE

SEQ ID NO: 1353 - protein, 42 aa, Artificial Sequence
  chemically synthesized
SQVSPFKIPIEELDDKVFVNCNTSIYRASSLSNCRHTSSVEE

SEQ ID NO: 1354 - protein, 42 aa, Artificial Sequence
  chemically synthesized
SQVSPFKIPIEELDDHVFVNCNTSIYRASSLSNCRHTSSVEE

SEQ ID NO: 1355 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELDDXVFVNCNTSIYRASSLSNCRHTSSVEE

SEQ ID NO: 1356 - protein, 42 aa, Artificial Sequence
  chemically synthesized
SQVSPFKIPIEELDDRIFVNCNTSIYRASSLSNCRHTSSVEE

SEQ ID NO: 1357 - protein, 42 aa, Artificial Sequence
  chemically synthesized
SQVSPFKIPIEELDDRLFVNCNTSIYRASSLSNCRHTSSVEE

SEQ ID NO: 1358 - protein, 42 aa, Artificial Sequence
  chemically synthesized
SQVSPFKIPIEELDDRFFVNCNTSIYRASSLSNCRHTSSVEE

SEQ ID NO: 1359 - protein, 42 aa, Artificial Sequence
  chemically synthesized
SQVSPFKIPIEELDDRHFVNCNTSIYRASSLSNCRHTSSVEE

SEQ ID NO: 1360 - protein, 42 aa, Artificial Sequence
  chemically synthesized
SQVSPFKIPIEELDDRMFVNCNTSIYRASSLSNCRHTSSVEE

SEQ ID NO: 1361 - protein, 42 aa, Artificial Sequence
  chemically synthesized
SQVSPFKIPIEELDDRVIVNCNTSIYRASSLSNCRHTSSVEE

SEQ ID NO: 1362 - protein, 42 aa, Artificial Sequence
  chemically synthesized
SQVSPFKIPIEELDDRVLVNCNTSIYRASSLSNCRHTSSVEE

SEQ ID NO: 1363 - protein, 42 aa, Artificial Sequence
  chemically synthesized
SQVSPFKIPIEELDDRVVVNCNTSIYRASSLSNCRHTSSVEE

SEQ ID NO: 1364 - protein, 42 aa, Artificial Sequence
  chemically synthesized
SQVSPFKIPIEELDDRVHVNCNTSIYRASSLSNCRHTSSVEE

SEQ ID NO: 1365 - protein, 42 aa, Artificial Sequence
  chemically synthesized
SQVSPFKIPIEELDDRVMVNCNTSIYRASSLSNCRHTSSVEE

SEQ ID NO: 1366 - protein, 42 aa, Artificial Sequence
  chemically synthesized
SQVSPFKIPIEELDDRVFINCNTSIYRASSLSNCRHTSSVEE

SEQ ID NO: 1367 - protein, 42 aa, Artificial Sequence
  chemically synthesized
SQVSPFKIPIEELDDRVFLNCNTSIYRASSLSNCRHTSSVEE

SEQ ID NO: 1368 - protein, 42 aa, Artificial Sequence
  chemically synthesized
SQVSPFKIPIEELDDRVFFNCNTSIYRASSLSNCRHTSSVEE

SEQ ID NO: 1369 - protein, 42 aa, Artificial Sequence
  chemically synthesized
SQVSPFKIPIEELDDRVFHNCNTSIYRASSLSNCRHTSSVEE

SEQ ID NO: 1370 - protein, 42 aa, Artificial Sequence
  chemically synthesized
SQVSPFKIPIEELDDRVFMNCNTSIYRASSLSNCRHTSSVEE

SEQ ID NO: 1371 - protein, 42 aa, Artificial Sequence
  chemically synthesized
SQVSPFKIPIEELDDRVFVQCNTSIYRASSLSNCRHTSSVEE

SEQ ID NO: 1372 - protein, 42 aa, Artificial Sequence
  chemically synthesized
SQVSPFKIPIEELDDRVFVNSNTSIYRASSLSNCRHTSSVEE

SEQ ID NO: 1373 - protein, 42 aa, Artificial Sequence
  chemically synthesized
SQVSPFKIPIEELDDRVFVNGNTSIYRASSLSNCRHTSSVEE

SEQ ID NO: 1374 - protein, 42 aa, Artificial Sequence
  chemically synthesized
SQVSPFKIPIEELDDRVFVNANTSIYRASSLSNCRHTSSVEE

SEQ ID NO: 1375 - protein, 42 aa, Artificial Sequence
  chemically synthesized
SQVSPFKIPIEELDDRVFVNCQTSIYRASSLSNCRHTSSVEE

SEQ ID NO: 1376 - protein, 42 aa, Artificial Sequence
  chemically synthesized
SQVSPFKIPIEELDDRVFVNCNSSIYRASSLSNCRHTSSVEE

SEQ ID NO: 1377 - protein, 42 aa, Artificial Sequence
  chemically synthesized
SQVSPFKIPIEELDDRVFVNCNYSIYRASSLSNCRHTSSVEE

SEQ ID NO: 1378 - protein, 42 aa, Artificial Sequence
  chemically synthesized
SQVSPFKIPIEELDDRVFVNCNTTIYRASSLSNCRHTSSVEE

SEQ ID NO: 1379 - protein, 42 aa, Artificial Sequence
  chemically synthesized
SQVSPFKIPIEELDDRVFVNCNTYIYRASSLSNCRHTSSVEE

SEQ ID NO: 1380 - protein, 42 aa, Artificial Sequence
  chemically synthesized
SQVSPFKIPIEELDDRVFVNCNTSVYRASSLSNCRHTSSVEE

SEQ ID NO: 1381 - protein, 42 aa, Artificial Sequence
  chemically synthesized
SQVSPFKIPIEELDDRVFVNCNTSLYRASSLSNCRHTSSVEE

SEQ ID NO: 1382 - protein, 42 aa, Artificial Sequence
  chemically synthesized
SQVSPFKIPIEELDDRVFVNCNTSHYRASSLSNCRHTSSVEE

SEQ ID NO: 1383 - protein, 42 aa, Artificial Sequence
  chemically synthesized
SQVSPFKIPIEELDDRVFVNCNTSFYRASSLSNCRHTSSVEE

SEQ ID NO: 1384 - protein, 42 aa, Artificial Sequence
  chemically synthesized
SQVSPFKIPIEELDDRVFVNCNTSMYRASSLSNCRHTSSVEE

SEQ ID NO: 1385 - protein, 42 aa, Artificial Sequence
  chemically synthesized
SQVSPFKIPIEELDDRVFVNCNTSIWRASSLSNCRHTSSVEE

SEQ ID NO: 1386 - protein, 42 aa, Artificial Sequence
  chemically synthesized
SQVSPFKIPIEELDDRVFVNCNTSIFRASSLSNCRHTSSVEE

SEQ ID NO: 1387 - protein, 42 aa, Artificial Sequence
  chemically synthesized
SQVSPFKIPIEELDDRVFVNCNTSISRASSLSNCRHTSSVEE

SEQ ID NO: 1388 - protein, 42 aa, Artificial Sequence
  chemically synthesized
SQVSPFKIPIEELDDRVFVNCNTSITRASSLSNCRHTSSVEE

SEQ ID NO: 1389 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELDDRVFVNCNTSIYXASSLSNCRHTSSVEE

SEQ ID NO: 1390 - protein, 42 aa, Artificial Sequence
  chemically synthesized
SQVSPFKIPIEELDDRVFVNCNTSIYHASSLSNCRHTSSVEE

SEQ ID NO: 1391 - protein, 42 aa, Artificial Sequence
  chemically synthesized
SQVSPFKIPIEELDDRVFVNCNTSIYKASSLSNCRHTSSVEE

SEQ ID NO: 1392 - protein, 42 aa, Artificial Sequence
  chemically synthesized
SQVSPFKIPIEELDDRVFVNCNTSIYRGSSLSNCRHTSSVEE

SEQ ID NO: 1393 - protein, 42 aa, Artificial Sequence
  chemically synthesized
SQVSPFKIPIEELDDRVFVNCNTSIYRATSLSNCRHTSSVEE

SEQ ID NO: 1394 - protein, 42 aa, Artificial Sequence
  chemically synthesized
SQVSPFKIPIEELDDRVFVNCNTSIYRAYSLSNCRHTSSVEE

SEQ ID NO: 1395 - protein, 42 aa, Artificial Sequence
  chemically synthesized
SQVSPFKIPIEELDDRVFVNCNTSIYRASTLSNCRHTSSVEE

SEQ ID NO: 1396 - protein, 42 aa, Artificial Sequence
  chemically synthesized
SQVSPFKIPIEELDDRVFVNCNTSIYRASYLSNCRHTSSVEE

SEQ ID NO: 1397 - protein, 42 aa, Artificial Sequence
  chemically synthesized
SQVSPFKIPIEELDDRVFVNCNTSIYRASSISNCRHTSSVEE

SEQ ID NO: 1398 - protein, 42 aa, Artificial Sequence
  chemically synthesized
SQVSPFKIPIEELDDRVFVNCNTSIYRASSVSNCRHTSSVEE

SEQ ID NO: 1399 - protein, 42 aa, Artificial Sequence
  chemically synthesized
SQVSPFKIPIEELDDRVFVNCNTSIYRASSFSNCRHTSSVEE

SEQ ID NO: 1400 - protein, 42 aa, Artificial Sequence
  chemically synthesized
SQVSPFKIPIEELDDRVFVNCNTSIYRASSMSNCRHTSSVEE

SEQ ID NO: 1401 - protein, 42 aa, Artificial Sequence
  chemically synthesized
SQVSPFKIPIEELDDRVFVNCNTSIYRASSHSNCRHTSSVEE

SEQ ID NO: 1402 - protein, 42 aa, Artificial Sequence
  chemically synthesized
SQVSPFKIPIEELDDRVFVNCNTSIYRASSLTNCRHTSSVEE

SEQ ID NO: 1403 - protein, 42 aa, Artificial Sequence
  chemically synthesized
SQVSPFKIPIEELDDRVFVNCNTSIYRASSLYNCRHTSSVEE

SEQ ID NO: 1404 - protein, 42 aa, Artificial Sequence
  chemically synthesized
SQVSPFKIPIEELDDRVFVNCNTSIYRASSLSQCRHTSSVEE

SEQ ID NO: 1405 - protein, 42 aa, Artificial Sequence
  chemically synthesized
SQVSPFKIPIEELDDRVFVNCNTSIYRASSLSNSRHTSSVEE

SEQ ID NO: 1406 - protein, 42 aa, Artificial Sequence
  chemically synthesized
SQVSPFKIPIEELDDRVFVNCNTSIYRASSLSNGRHTSSVEE

SEQ ID NO: 1407 - protein, 42 aa, Artificial Sequence
  chemically synthesized
SQVSPFKIPIEELDDRVFVNCNTSIYRASSLSNARHTSSVEE

SEQ ID NO: 1408 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELDDRVFVNCNTSIYRASSLSNCXHTSSVEE

SEQ ID NO: 1409 - protein, 42 aa, Artificial Sequence
  chemically synthesized
SQVSPFKIPIEELDDRVFVNCNTSIYRASSLSNCHHTSSVEE

SEQ ID NO: 1410 - protein, 42 aa, Artificial Sequence
  chemically synthesized
SQVSPFKIPIEELDDRVFVNCNTSIYRASSLSNCKHTSSVEE

SEQ ID NO: 1411 - protein, 42 aa, Artificial Sequence
  chemically synthesized
SQVSPFKIPIEELDDRVFVNCNTSIYRASSLSNCRGTSSVEE

SEQ ID NO: 1412 - protein, 42 aa, Artificial Sequence
  chemically synthesized
SQVSPFKIPIEELDDRVFVNCNTSIYRASSLSNCRATSSVEE

SEQ ID NO: 1413 - protein, 42 aa, Artificial Sequence
  chemically synthesized
SQVSPFKIPIEELDDRVFVNCNTSIYRASSLSNCRITSSVEE

SEQ ID NO: 1414 - protein, 42 aa, Artificial Sequence
  chemically synthesized
SQVSPFKIPIEELDDRVFVNCNTSIYRASSLSNCRLTSSVEE

SEQ ID NO: 1415 - protein, 42 aa, Artificial Sequence
  chemically synthesized
SQVSPFKIPIEELDDRVFVNCNTSIYRASSLSNCRMTSSVEE

SEQ ID NO: 1416 - protein, 42 aa, Artificial Sequence
  chemically synthesized
SQVSPFKIPIEELDDRVFVNCNTSIYRASSLSNCRVTSSVEE

SEQ ID NO: 1417 - protein, 42 aa, Artificial Sequence
  chemically synthesized
SQVSPFKIPIEELDDRVFVNCNTSIYRASSLSNCRHSSSVEE

SEQ ID NO: 1418 - protein, 42 aa, Artificial Sequence
  chemically synthesized
SQVSPFKIPIEELDDRVFVNCNTSIYRASSLSNCRHYSSVEE

SEQ ID NO: 1419 - protein, 42 aa, Artificial Sequence
  chemically synthesized
SQVSPFKIPIEELDDRVFVNCNTSIYRASSLSNCRHTTSVEE

SEQ ID NO: 1420 - protein, 42 aa, Artificial Sequence
  chemically synthesized
SQVSPFKIPIEELDDRVFVNCNTSIYRASSLSNCRHTYSVEE

SEQ ID NO: 1421 - protein, 42 aa, Artificial Sequence
  chemically synthesized
SQVSPFKIPIEELDDRVFVNCNTSIYRASSLSNCRHTSTVEE

SEQ ID NO: 1422 - protein, 42 aa, Artificial Sequence
  chemically synthesized
SQVSPFKIPIEELDDRVFVNCNTSIYRASSLSNCRHTSYVEE

SEQ ID NO: 1423 - protein, 42 aa, Artificial Sequence
  chemically synthesized
SQVSPFKIPIEELDDRVFVNCNTSIYRASSLSNCRHTSSIEE

SEQ ID NO: 1424 - protein, 42 aa, Artificial Sequence
  chemically synthesized
SQVSPFKIPIEELDDRVFVNCNTSIYRASSLSNCRHTSSLEE

SEQ ID NO: 1425 - protein, 42 aa, Artificial Sequence
  chemically synthesized
SQVSPFKIPIEELDDRVFVNCNTSIYRASSLSNCRHTSSFEE

SEQ ID NO: 1426 - protein, 42 aa, Artificial Sequence
  chemically synthesized
SQVSPFKIPIEELDDRVFVNCNTSIYRASSLSNCRHTSSHEE

SEQ ID NO: 1427 - protein, 42 aa, Artificial Sequence
  chemically synthesized
SQVSPFKIPIEELDDRVFVNCNTSIYRASSLSNCRHTSSMEE

SEQ ID NO: 1428 - protein, 42 aa, Artificial Sequence
  chemically synthesized
SQVSPFKIPIEELDDRVFVNCNTSIYRASSLSNCRHTSSVDE

SEQ ID NO: 1429 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELDDRVFVNCNTSIYRASSLSNCRHTSSVXE

SEQ ID NO: 1430 - protein, 42 aa, Artificial Sequence
  chemically synthesized
SQVSPFKIPIEELDDRVFVNCNTSIYRASSLSNCRHTSSVED

SEQ ID NO: 1431 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELDDRVFVNCNTSIYRASSLSNCRHTSSVEX

SEQ ID NO: 1432 - protein, 42 aa, Artificial Sequence
  chemically synthesized
SQVSAFKIPIEELDDRVFVNCNTSIYRASSLSNCRHTSSVEE

SEQ ID NO: 1433 - protein, 42 aa, Artificial Sequence
  chemically synthesized
SQVSGFKIPIEELDDRVFVNCNTSIYRASSLSNCRHTSSVEE

SEQ ID NO: 1434 - protein, 42 aa, Artificial Sequence
  chemically synthesized
SQVSPFKIAIEELDDRVFVNCNTSIYRASSLSNCRHTSSVEE

SEQ ID NO: 1435 - protein, 42 aa, Artificial Sequence
  chemically synthesized
SQVSPFKIGIEELDDRVFVNCNTSIYRASSLSNCRHTSSVEE

SEQ ID NO: 1436 - protein, 42 aa, Artificial Sequence; identical to SEQ ID NO: 43
  chemically synthesized

SEQ ID NO: 1437 - protein, 42 aa, Artificial Sequence; identical to SEQ ID NO: 162
  chemically synthesized

SEQ ID NO: 1438 - protein, 42 aa, Artificial Sequence
  chemically synthesized
YQVSPFKIPIEELEDKVFVNCNTSIYRASSLSNCRHTSSVEE

SEQ ID NO: 1439 - protein, 42 aa, Artificial Sequence; identical to SEQ ID NO: 282
  chemically synthesized

SEQ ID NO: 1440 - protein, 42 aa, Artificial Sequence; identical to SEQ ID NO: 400
  chemically synthesized

SEQ ID NO: 1441 - protein, 42 aa, Artificial Sequence
  chemically synthesized
SQISPFKIPIEELEDKVFVNCNTSIYRASSLSNCRHTSSVEE

SEQ ID NO: 1442 - protein, 42 aa, Artificial Sequence
  chemically synthesized
SQPSPFKIPIEELEDKVFVNCNTSIYRASSLSNCRHTSSVEE

SEQ ID NO: 1443 - protein, 42 aa, Artificial Sequence
  chemically synthesized
SQFSPFKIPIEELEDKVFVNCNTSIYRASSLSNCRHTSSVEE

SEQ ID NO: 1444 - protein, 42 aa, Artificial Sequence; identical to SEQ ID NO: 519
  chemically synthesized

SEQ ID NO: 1445 - protein, 42 aa, Artificial Sequence
  chemically synthesized
SQVYPFKIPIEELEDKVFVNCNTSIYRASSLSNCRHTSSVEE

SEQ ID NO: 1446 - protein, 42 aa, Artificial Sequence
  chemically synthesized
SQVSPWKIPIEELEDKVFVNCNTSIYRASSLSNCRHTSSVEE

SEQ ID NO: 1447 - protein, 42 aa, Artificial Sequence
  chemically synthesized
SQVSPYKIPIEELEDKVFVNCNTSIYRASSLSNCRHTSSVEE

SEQ ID NO: 1448 - protein, 42 aa, Artificial Sequence
  chemically synthesized
SQVSPHKIPIEELEDKVFVNCNTSIYRASSLSNCRHTSSVEE

SEQ ID NO: 1449 - protein, 42 aa, Artificial Sequence
  chemically synthesized
SQVSPFRIPIEELEDKVFVNCNTSIYRASSLSNCRHTSSVEE

SEQ ID NO: 1450 - protein, 42 aa, Artificial Sequence
  chemically synthesized
SQVSPFHIPIEELEDKVFVNCNTSIYRASSLSNCRHTSSVEE

SEQ ID NO: 1451 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDKVFVNCNTSIYRASSLSNCRHTSSVEE

SEQ ID NO: 1452 - protein, 42 aa, Artificial Sequence; identical to SEQ ID NO: 758
  chemically synthesized

SEQ ID NO: 1453 - protein, 42 aa, Artificial Sequence
  chemically synthesized
SQVSPFKHPIEELEDKVFVNCNTSIYRASSLSNCRHTSSVEE

SEQ ID NO: 1454 - protein, 42 aa, Artificial Sequence
  chemically synthesized
SQVSPFKVPIEELEDKVFVNCNTSIYRASSLSNCRHTSSVEE

SEQ ID NO: 1455 - protein, 42 aa, Artificial Sequence
  chemically synthesized
SQVSPFKFPIEELEDKVFVNCNTSIYRASSLSNCRHTSSVEE

SEQ ID NO: 1456 - protein, 42 aa, Artificial Sequence
  chemically synthesized
SQVSPFKMPIEELEDKVFVNCNTSIYRASSLSNCRHTSSVEE

SEQ ID NO: 1457 - protein, 42 aa, Artificial Sequence; identical to SEQ ID NO: 876
  chemically synthesized

SEQ ID NO: 1458 - protein, 42 aa, Artificial Sequence
  chemically synthesized
SQVSPFKIPHEELEDKVFVNCNTSIYRASSLSNCRHTSSVEE

SEQ ID NO: 1459 - protein, 42 aa, Artificial Sequence
  chemically synthesized
SQVSPFKIPVEELEDKVFVNCNTSIYRASSLSNCRHTSSVEE

SEQ ID NO: 1460 - protein, 42 aa, Artificial Sequence
  chemically synthesized
SQVSPFKIPFEELEDKVFVNCNTSIYRASSLSNCRHTSSVEE

SEQ ID NO: 1461 - protein, 42 aa, Artificial Sequence
  chemically synthesized
SQVSPFKIPMEELEDKVFVNCNTSIYRASSLSNCRHTSSVEE

SEQ ID NO: 1462 - protein, 42 aa, Artificial Sequence; identical to SEQ ID NO: 996
  chemically synthesized

SEQ ID NO: 1463 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDKVFVNCNTSIYRASSLSNCRHTSSVEE

SEQ ID NO: 1464 - protein, 42 aa, Artificial Sequence; identical to SEQ ID NO: 1116
  chemically synthesized

SEQ ID NO: 1465 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDKVFVNCNTSIYRASSLSNCRHTSSVEE

SEQ ID NO: 1466 - protein, 42 aa, Artificial Sequence
  chemically synthesized
SQVSPFKIPIEEVEDKVFVNCNTSIYRASSLSNCRHTSSVEE

SEQ ID NO: 1467 - protein, 42 aa, Artificial Sequence; identical to SEQ ID NO: 1233
  chemically synthesized

SEQ ID NO: 1468 - protein, 42 aa, Artificial Sequence
  chemically synthesized
SQVSPFKIPIEEFEDKVFVNCNTSIYRASSLSNCRHTSSVEE

SEQ ID NO: 1469 - protein, 42 aa, Artificial Sequence
  chemically synthesized
SQVSPFKIPIEEHEDKVFVNCNTSIYRASSLSNCRHTSSVEE

SEQ ID NO: 1470 - protein, 42 aa, Artificial Sequence
  chemically synthesized
SQVSPFKIPIEEMEDKVFVNCNTSIYRASSLSNCRHTSSVEE

SEQ ID NO: 1471 - protein, 42 aa, Artificial Sequence; identical to SEQ ID NO: 1353
  chemically synthesized

SEQ ID NO: 1472 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDKVFVNCNTSIYRASSLSNCRHTSSVEE

SEQ ID NO: 1473 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXKVFVNCNTSIYRASSLSNCRHTSSVEE

SEQ ID NO: 1474 - protein, 42 aa, Artificial Sequence
  chemically synthesized
SQVSPFKIPIEELEEKVFVNCNTSIYRASSLSNCRHTSSVEE

SEQ ID NO: 1475 - protein, 42 aa, Artificial Sequence
  chemically synthesized
SQVSPFKIPIEELEDKIFVNCNTSIYRASSLSNCRHTSSVEE

SEQ ID NO: 1476 - protein, 42 aa, Artificial Sequence
  chemically synthesized
SQVSPFKIPIEELEDKLFVNCNTSIYRASSLSNCRHTSSVEE

SEQ ID NO: 1477 - protein, 42 aa, Artificial Sequence
  chemically synthesized
SQVSPFKIPIEELEDKFFVNCNTSIYRASSLSNCRHTSSVEE

SEQ ID NO: 1478 - protein, 42 aa, Artificial Sequence
  chemically synthesized
SQVSPFKIPIEELEDKHFVNCNTSIYRASSLSNCRHTSSVEE

SEQ ID NO: 1479 - protein, 42 aa, Artificial Sequence
  chemically synthesized
SQVSPFKIPIEELEDKMFVNCNTSIYRASSLSNCRHTSSVEE

SEQ ID NO: 1480 - protein, 42 aa, Artificial Sequence
  chemically synthesized
SQVSPFKIPIEELEDKVIVNCNTSIYRASSLSNCRHTSSVEE

SEQ ID NO: 1481 - protein, 42 aa, Artificial Sequence
  chemically synthesized
SQVSPFKIPIEELEDKVLVNCNTSIYRASSLSNCRHTSSVEE

SEQ ID NO: 1482 - protein, 42 aa, Artificial Sequence
  chemically synthesized
SQVSPFKIPIEELEDKVVVNCNTSIYRASSLSNCRHTSSVEE

SEQ ID NO: 1483 - protein, 42 aa, Artificial Sequence
  chemically synthesized
SQVSPFKIPIEELEDKVHVNCNTSIYRASSLSNCRHTSSVEE

SEQ ID NO: 1484 - protein, 42 aa, Artificial Sequence
  chemically synthesized
SQVSPFKIPIEELEDKVMVNCNTSIYRASSLSNCRHTSSVEE

SEQ ID NO: 1485 - protein, 42 aa, Artificial Sequence
  chemically synthesized
SQVSPFKIPIEELEDKVFINCNTSIYRASSLSNCRHTSSVEE

SEQ ID NO: 1486 - protein, 42 aa, Artificial Sequence
  chemically synthesized
SQVSPFKIPIEELEDKVFLNCNTSIYRASSLSNCRHTSSVEE

SEQ ID NO: 1487 - protein, 42 aa, Artificial Sequence
  chemically synthesized
SQVSPFKIPIEELEDKVFFNCNTSIYRASSLSNCRHTSSVEE

SEQ ID NO: 1488 - protein, 42 aa, Artificial Sequence
  chemically synthesized
SQVSPFKIPIEELEDKVFHNCNTSIYRASSLSNCRHTSSVEE

SEQ ID NO: 1489 - protein, 42 aa, Artificial Sequence
  chemically synthesized
SQVSPFKIPIEELEDKVFMNCNTSIYRASSLSNCRHTSSVEE

SEQ ID NO: 1490 - protein, 42 aa, Artificial Sequence
  chemically synthesized
SQVSPFKIPIEELEDKVFVQCNTSIYRASSLSNCRHTSSVEE

SEQ ID NO: 1491 - protein, 42 aa, Artificial Sequence
  chemically synthesized
SQVSPFKIPIEELEDKVFVNSNTSIYRASSLSNCRHTSSVEE

SEQ ID NO: 1492 - protein, 42 aa, Artificial Sequence
  chemically synthesized
SQVSPFKIPIEELEDKVFVNGNTSIYRASSLSNCRHTSSVEE

SEQ ID NO: 1493 - protein, 42 aa, Artificial Sequence
  chemically synthesized
SQVSPFKIPIEELEDKVFVNANTSIYRASSLSNCRHTSSVEE

SEQ ID NO: 1494 - protein, 42 aa, Artificial Sequence
  chemically synthesized
SQVSPFKIPIEELEDKVFVNCQTSIYRASSLSNCRHTSSVEE

SEQ ID NO: 1495 - protein, 42 aa, Artificial Sequence
  chemically synthesized
SQVSPFKIPIEELEDKVFVNCNSSIYRASSLSNCRHTSSVEE

SEQ ID NO: 1496 - protein, 42 aa, Artificial Sequence
  chemically synthesized
SQVSPFKIPIEELEDKVFVNCNYSIYRASSLSNCRHTSSVEE

SEQ ID NO: 1497 - protein, 42 aa, Artificial Sequence
  chemically synthesized
SQVSPFKIPIEELEDKVFVNCNTTIYRASSLSNCRHTSSVEE

SEQ ID NO: 1498 - protein, 42 aa, Artificial Sequence
  chemically synthesized
SQVSPFKIPIEELEDKVFVNCNTYIYRASSLSNCRHTSSVEE

SEQ ID NO: 1499 - protein, 42 aa, Artificial Sequence
  chemically synthesized
SQVSPFKIPIEELEDKVFVNCNTSVYRASSLSNCRHTSSVEE

SEQ ID NO: 1500 - protein, 42 aa, Artificial Sequence
  chemically synthesized
SQVSPFKIPIEELEDKVFVNCNTSLYRASSLSNCRHTSSVEE

SEQ ID NO: 1501 - protein, 42 aa, Artificial Sequence
  chemically synthesized
SQVSPFKIPIEELEDKVFVNCNTSHYRASSLSNCRHTSSVEE

SEQ ID NO: 1502 - protein, 42 aa, Artificial Sequence
  chemically synthesized
SQVSPFKIPIEELEDKVFVNCNTSFYRASSLSNCRHTSSVEE

SEQ ID NO: 1503 - protein, 42 aa, Artificial Sequence
  chemically synthesized
SQVSPFKIPIEELEDKVFVNCNTSMYRASSLSNCRHTSSVEE

SEQ ID NO: 1504 - protein, 42 aa, Artificial Sequence
  chemically synthesized
SQVSPFKIPIEELEDKVFVNCNTSIWRASSLSNCRHTSSVEE

SEQ ID NO: 1505 - protein, 42 aa, Artificial Sequence
  chemically synthesized
SQVSPFKIPIEELEDKVFVNCNTSIFRASSLSNCRHTSSVEE

SEQ ID NO: 1506 - protein, 42 aa, Artificial Sequence
  chemically synthesized
SQVSPFKIPIEELEDKVFVNCNTSISRASSLSNCRHTSSVEE

SEQ ID NO: 1507 - protein, 42 aa, Artificial Sequence
  chemically synthesized
SQVSPFKIPIEELEDKVFVNCNTSITRASSLSNCRHTSSVEE

SEQ ID NO: 1508 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDKVFVNCNTSIYXASSLSNCRHTSSVEE

SEQ ID NO: 1509 - protein, 42 aa, Artificial Sequence
  chemically synthesized
SQVSPFKIPIEELEDKVFVNCNTSIYHASSLSNCRHTSSVEE

SEQ ID NO: 1510 - protein, 42 aa, Artificial Sequence
  chemically synthesized
SQVSPFKIPIEELEDKVFVNCNTSIYKASSLSNCRHTSSVEE

SEQ ID NO: 1511 - protein, 42 aa, Artificial Sequence
  chemically synthesized
SQVSPFKIPIEELEDKVFVNCNTSIYRGSSLSNCRHTSSVEE

SEQ ID NO: 1512 - protein, 42 aa, Artificial Sequence
  chemically synthesized
SQVSPFKIPIEELEDKVFVNCNTSIYRATSLSNCRHTSSVEE

SEQ ID NO: 1513 - protein, 42 aa, Artificial Sequence
  chemically synthesized
SQVSPFKIPIEELEDKVFVNCNTSIYRAYSLSNCRHTSSVEE

SEQ ID NO: 1514 - protein, 42 aa, Artificial Sequence
  chemically synthesized
SQVSPFKIPIEELEDKVFVNCNTSIYRASTLSNCRHTSSVEE

SEQ ID NO: 1515 - protein, 42 aa, Artificial Sequence
  chemically synthesized
SQVSPFKIPIEELEDKVFVNCNTSIYRASYLSNCRHTSSVEE

SEQ ID NO: 1516 - protein, 42 aa, Artificial Sequence
  chemically synthesized
SQVSPFKIPIEELEDKVFVNCNTSIYRASSISNCRHTSSVEE

SEQ ID NO: 1517 - protein, 42 aa, Artificial Sequence
  chemically synthesized
SQVSPFKIPIEELEDKVFVNCNTSIYRASSVSNCRHTSSVEE

SEQ ID NO: 1518 - protein, 42 aa, Artificial Sequence
  chemically synthesized
SQVSPFKIPIEELEDKVFVNCNTSIYRASSFSNCRHTSSVEE

SEQ ID NO: 1519 - protein, 42 aa, Artificial Sequence
  chemically synthesized
SQVSPFKIPIEELEDKVFVNCNTSIYRASSMSNCRHTSSVEE

SEQ ID NO: 1520 - protein, 42 aa, Artificial Sequence
  chemically synthesized
SQVSPFKIPIEELEDKVFVNCNTSIYRASSHSNCRHTSSVEE

SEQ ID NO: 1521 - protein, 42 aa, Artificial Sequence
  chemically synthesized
SQVSPFKIPIEELEDKVFVNCNTSIYRASSLTNCRHTSSVEE

SEQ ID NO: 1522 - protein, 42 aa, Artificial Sequence
  chemically synthesized
SQVSPFKIPIEELEDKVFVNCNTSIYRASSLYNCRHTSSVEE

SEQ ID NO: 1523 - protein, 42 aa, Artificial Sequence
  chemically synthesized
SQVSPFKIPIEELEDKVFVNCNTSIYRASSLSQCRHTSSVEE

SEQ ID NO: 1524 - protein, 42 aa, Artificial Sequence
  chemically synthesized
SQVSPFKIPIEELEDKVFVNCNTSIYRASSLSNSRHTSSVEE

SEQ ID NO: 1525 - protein, 42 aa, Artificial Sequence
  chemically synthesized
SQVSPFKIPIEELEDKVFVNCNTSIYRASSLSNGRHTSSVEE

SEQ ID NO: 1526 - protein, 42 aa, Artificial Sequence
  chemically synthesized
SQVSPFKIPIEELEDKVFVNCNTSIYRASSLSNARHTSSVEE

SEQ ID NO: 1527 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDKVFVNCNTSIYRASSLSNCXHTSSVEE

SEQ ID NO: 1528 - protein, 42 aa, Artificial Sequence
  chemically synthesized
SQVSPFKIPIEELEDKVFVNCNTSIYRASSLSNCHHTSSVEE

SEQ ID NO: 1529 - protein, 42 aa, Artificial Sequence
  chemically synthesized
SQVSPFKIPIEELEDKVFVNCNTSIYRASSLSNCKHTSSVEE

SEQ ID NO: 1530 - protein, 42 aa, Artificial Sequence
  chemically synthesized
SQVSPFKIPIEELEDKVFVNCNTSIYRASSLSNCRGTSSVEE

SEQ ID NO: 1531 - protein, 42 aa, Artificial Sequence
  chemically synthesized
SQVSPFKIPIEELEDKVFVNCNTSIYRASSLSNCRATSSVEE

SEQ ID NO: 1532 - protein, 42 aa, Artificial Sequence
  chemically synthesized
SQVSPFKIPIEELEDKVFVNCNTSIYRASSLSNCRITSSVEE

SEQ ID NO: 1533 - protein, 42 aa, Artificial Sequence
  chemically synthesized
SQVSPFKIPIEELEDKVFVNCNTSIYRASSLSNCRLTSSVEE

SEQ ID NO: 1534 - protein, 42 aa, Artificial Sequence
  chemically synthesized
SQVSPFKIPIEELEDKVFVNCNTSIYRASSLSNCRMTSSVEE

SEQ ID NO: 1535 - protein, 42 aa, Artificial Sequence
  chemically synthesized
SQVSPFKIPIEELEDKVFVNCNTSIYRASSLSNCRVTSSVEE

SEQ ID NO: 1536 - protein, 42 aa, Artificial Sequence
  chemically synthesized
SQVSPFKIPIEELEDKVFVNCNTSIYRASSLSNCRHSSSVEE

SEQ ID NO: 1537 - protein, 42 aa, Artificial Sequence
  chemically synthesized
SQVSPFKIPIEELEDKVFVNCNTSIYRASSLSNCRHYSSVEE

SEQ ID NO: 1538 - protein, 42 aa, Artificial Sequence
  chemically synthesized
SQVSPFKIPIEELEDKVFVNCNTSIYRASSLSNCRHTTSVEE

SEQ ID NO: 1539 - protein, 42 aa, Artificial Sequence
  chemically synthesized
SQVSPFKIPIEELEDKVFVNCNTSIYRASSLSNCRHTYSVEE

SEQ ID NO: 1540 - protein, 42 aa, Artificial Sequence
  chemically synthesized
SQVSPFKIPIEELEDKVFVNCNTSIYRASSLSNCRHTSTVEE

SEQ ID NO: 1541 - protein, 42 aa, Artificial Sequence
  chemically synthesized
SQVSPFKIPIEELEDKVFVNCNTSIYRASSLSNCRHTSYVEE

SEQ ID NO: 1542 - protein, 42 aa, Artificial Sequence
  chemically synthesized
SQVSPFKIPIEELEDKVFVNCNTSIYRASSLSNCRHTSSIEE

SEQ ID NO: 1543 - protein, 42 aa, Artificial Sequence
  chemically synthesized
SQVSPFKIPIEELEDKVFVNCNTSIYRASSLSNCRHTSSLEE

SEQ ID NO: 1544 - protein, 42 aa, Artificial Sequence
  chemically synthesized
SQVSPFKIPIEELEDKVFVNCNTSIYRASSLSNCRHTSSFEE

SEQ ID NO: 1545 - protein, 42 aa, Artificial Sequence
  chemically synthesized
SQVSPFKIPIEELEDKVFVNCNTSIYRASSLSNCRHTSSHEE

SEQ ID NO: 1546 - protein, 42 aa, Artificial Sequence
  chemically synthesized
SQVSPFKIPIEELEDKVFVNCNTSIYRASSLSNCRHTSSMEE

SEQ ID NO: 1547 - protein, 42 aa, Artificial Sequence
  chemically synthesized
SQVSPFKIPIEELEDKVFVNCNTSIYRASSLSNCRHTSSVDE

SEQ ID NO: 1548 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDKVFVNCNTSIYRASSLSNCRHTSSVXE

SEQ ID NO: 1549 - protein, 42 aa, Artificial Sequence
  chemically synthesized
SQVSPFKIPIEELEDKVFVNCNTSIYRASSLSNCRHTSSVED

SEQ ID NO: 1550 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDKVFVNCNTSIYRASSLSNCRHTSSVEX

SEQ ID NO: 1551 - protein, 42 aa, Artificial Sequence
  chemically synthesized
SQVSAFKIPIEELEDKVFVNCNTSIYRASSLSNCRHTSSVEE

SEQ ID NO: 1552 - protein, 42 aa, Artificial Sequence
  chemically synthesized
SQVSGFKIPIEELEDKVFVNCNTSIYRASSLSNCRHTSSVEE

SEQ ID NO: 1553 - protein, 42 aa, Artificial Sequence
  chemically synthesized
SQVSPFKIAIEELEDKVFVNCNTSIYRASSLSNCRHTSSVEE

SEQ ID NO: 1554 - protein, 42 aa, Artificial Sequence
  chemically synthesized
SQVSPFKIGIEELEDKVFVNCNTSIYRASSLSNCRHTSSVEE

SEQ ID NO: 1555 - protein, 42 aa, Artificial Sequence; identical to SEQ ID NO: 46
  chemically synthesized

SEQ ID NO: 1556 - protein, 42 aa, Artificial Sequence; identical to SEQ ID NO: 165
  chemically synthesized

SEQ ID NO: 1557 - protein, 42 aa, Artificial Sequence
  chemically synthesized
YQVSPFKIPIEELEDRIFVNCNTSIYRASSLSNCRHTSSVEE

SEQ ID NO: 1558 - protein, 42 aa, Artificial Sequence; identical to SEQ ID NO: 285
  chemically synthesized

SEQ ID NO: 1559 - protein, 42 aa, Artificial Sequence; identical to SEQ ID NO: 403
  chemically synthesized

SEQ ID NO: 1560 - protein, 42 aa, Artificial Sequence
  chemically synthesized
SQISPFKIPIEELEDRIFVNCNTSIYRASSLSNCRHTSSVEE

SEQ ID NO: 1561 - protein, 42 aa, Artificial Sequence
  chemically synthesized
SQPSPFKIPIEELEDRIFVNCNTSIYRASSLSNCRHTSSVEE

SEQ ID NO: 1562 - protein, 42 aa, Artificial Sequence
  chemically synthesized
SQFSPFKIPIEELEDRIFVNCNTSIYRASSLSNCRHTSSVEE

SEQ ID NO: 1563 - protein, 42 aa, Artificial Sequence; identical to SEQ ID NO: 522
  chemically synthesized

SEQ ID NO: 1564 - protein, 42 aa, Artificial Sequence
  chemically synthesized
SQVYPFKIPIEELEDRIFVNCNTSIYRASSLSNCRHTSSVEE

SEQ ID NO: 1565 - protein, 42 aa, Artificial Sequence
  chemically synthesized
SQVSPWKIPIEELEDRIFVNCNTSIYRASSLSNCRHTSSVEE

SEQ ID NO: 1566 - protein, 42 aa, Artificial Sequence
  chemically synthesized
SQVSPYKIPIEELEDRIFVNCNTSIYRASSLSNCRHTSSVEE

SEQ ID NO: 1567 - protein, 42 aa, Artificial Sequence
  chemically synthesized
SQVSPHKIPIEELEDRIFVNCNTSIYRASSLSNCRHTSSVEE

SEQ ID NO: 1568 - protein, 42 aa, Artificial Sequence
  chemically synthesized
SQVSPFRIPIEELEDRIFVNCNTSIYRASSLSNCRHTSSVEE

SEQ ID NO: 1569 - protein, 42 aa, Artificial Sequence
  chemically synthesized
SQVSPFHIPIEELEDRIFVNCNTSIYRASSLSNCRHTSSVEE

SEQ ID NO: 1570 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRIFVNCNTSIYRASSLSNCRHTSSVEE

SEQ ID NO: 1571 - protein, 42 aa, Artificial Sequence; identical to SEQ ID NO: 761
  chemically synthesized

SEQ ID NO: 1572 - protein, 42 aa, Artificial Sequence
  chemically synthesized
SQVSPFKHPIEELEDRIFVNCNTSIYRASSLSNCRHTSSVEE

SEQ ID NO: 1573 - protein, 42 aa, Artificial Sequence
  chemically synthesized
SQVSPFKVPIEELEDRIFVNCNTSIYRASSLSNCRHTSSVEE

SEQ ID NO: 1574 - protein, 42 aa, Artificial Sequence
  chemically synthesized
SQVSPFKFPIEELEDRIFVNCNTSIYRASSLSNCRHTSSVEE

SEQ ID NO: 1575 - protein, 42 aa, Artificial Sequence
  chemically synthesized
SQVSPFKMPIEELEDRIFVNCNTSIYRASSLSNCRHTSSVEE

SEQ ID NO: 1576 - protein, 42 aa, Artificial Sequence; identical to SEQ ID NO: 879
  chemically synthesized

SEQ ID NO: 1577 - protein, 42 aa, Artificial Sequence
  chemically synthesized
SQVSPFKIPHEELEDRIFVNCNTSIYRASSLSNCRHTSSVEE

SEQ ID NO: 1578 - protein, 42 aa, Artificial Sequence
  chemically synthesized
SQVSPFKIPVEELEDRIFVNCNTSIYRASSLSNCRHTSSVEE

SEQ ID NO: 1579 - protein, 42 aa, Artificial Sequence
  chemically synthesized
SQVSPFKIPFEELEDRIFVNCNTSIYRASSLSNCRHTSSVEE

SEQ ID NO: 1580 - protein, 42 aa, Artificial Sequence
  chemically synthesized
SQVSPFKIPMEELEDRIFVNCNTSIYRASSLSNCRHTSSVEE

SEQ ID NO: 1581 - protein, 42 aa, Artificial Sequence; identical to SEQ ID NO: 999
  chemically synthesized

SEQ ID NO: 1582 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRIFVNCNTSIYRASSLSNCRHTSSVEE

SEQ ID NO: 1583 - protein, 42 aa, Artificial Sequence; identical to SEQ ID NO: 1119
  chemically synthesized

SEQ ID NO: 1584 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRIFVNCNTSIYRASSLSNCRHTSSVEE

SEQ ID NO: 1585 - protein, 42 aa, Artificial Sequence
  chemically synthesized
SQVSPFKIPIEEVEDRIFVNCNTSIYRASSLSNCRHTSSVEE

SEQ ID NO: 1586 - protein, 42 aa, Artificial Sequence; identical to SEQ ID NO: 1236
  chemically synthesized

SEQ ID NO: 1587 - protein, 42 aa, Artificial Sequence
  chemically synthesized
SQVSPFKIPIEEFEDRIFVNCNTSIYRASSLSNCRHTSSVEE

SEQ ID NO: 1588 - protein, 42 aa, Artificial Sequence
  chemically synthesized
SQVSPFKIPIEEHEDRIFVNCNTSIYRASSLSNCRHTSSVEE

SEQ ID NO: 1589 - protein, 42 aa, Artificial Sequence
  chemically synthesized
SQVSPFKIPIEEMEDRIFVNCNTSIYRASSLSNCRHTSSVEE

SEQ ID NO: 1590 - protein, 42 aa, Artificial Sequence; identical to SEQ ID NO: 1356
  chemically synthesized

SEQ ID NO: 1591 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRIFVNCNTSIYRASSLSNCRHTSSVEE

SEQ ID NO: 1592 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRIFVNCNTSIYRASSLSNCRHTSSVEE

SEQ ID NO: 1593 - protein, 42 aa, Artificial Sequence
  chemically synthesized
SQVSPFKIPIEELEERIFVNCNTSIYRASSLSNCRHTSSVEE

SEQ ID NO: 1594 - protein, 42 aa, Artificial Sequence; identical to SEQ ID NO: 1475
  chemically synthesized

SEQ ID NO: 1595 - protein, 42 aa, Artificial Sequence
  chemically synthesized
SQVSPFKIPIEELEDHIFVNCNTSIYRASSLSNCRHTSSVEE

SEQ ID NO: 1596 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXIFVNCNTSIYRASSLSNCRHTSSVEE

SEQ ID NO: 1597 - protein, 42 aa, Artificial Sequence
  chemically synthesized
SQVSPFKIPIEELEDRIIVNCNTSIYRASSLSNCRHTSSVEE

SEQ ID NO: 1598 - protein, 42 aa, Artificial Sequence
  chemically synthesized
SQVSPFKIPIEELEDRILVNCNTSIYRASSLSNCRHTSSVEE

SEQ ID NO: 1599 - protein, 42 aa, Artificial Sequence
  chemically synthesized
SQVSPFKIPIEELEDRIVVNCNTSIYRASSLSNCRHTSSVEE

SEQ ID NO: 1600 - protein, 42 aa, Artificial Sequence
  chemically synthesized
SQVSPFKIPIEELEDRIHVNCNTSIYRASSLSNCRHTSSVEE

SEQ ID NO: 1601 - protein, 42 aa, Artificial Sequence
  chemically synthesized
SQVSPFKIPIEELEDRIMVNCNTSIYRASSLSNCRHTSSVEE

SEQ ID NO: 1602 - protein, 42 aa, Artificial Sequence
  chemically synthesized
SQVSPFKIPIEELEDRIFINCNTSIYRASSLSNCRHTSSVEE

SEQ ID NO: 1603 - protein, 42 aa, Artificial Sequence
  chemically synthesized
SQVSPFKIPIEELEDRIFLNCNTSIYRASSLSNCRHTSSVEE

SEQ ID NO: 1604 - protein, 42 aa, Artificial Sequence
  chemically synthesized
SQVSPFKIPIEELEDRIFFNCNTSIYRASSLSNCRHTSSVEE

SEQ ID NO: 1605 - protein, 42 aa, Artificial Sequence
  chemically synthesized
SQVSPFKIPIEELEDRIFHNCNTSIYRASSLSNCRHTSSVEE

SEQ ID NO: 1606 - protein, 42 aa, Artificial Sequence
  chemically synthesized
SQVSPFKIPIEELEDRIFMNCNTSIYRASSLSNCRHTSSVEE

SEQ ID NO: 1607 - protein, 42 aa, Artificial Sequence
  chemically synthesized
SQVSPFKIPIEELEDRIFVQCNTSIYRASSLSNCRHTSSVEE

SEQ ID NO: 1608 - protein, 42 aa, Artificial Sequence
  chemically synthesized
SQVSPFKIPIEELEDRIFVNSNTSIYRASSLSNCRHTSSVEE

SEQ ID NO: 1609 - protein, 42 aa, Artificial Sequence
  chemically synthesized
SQVSPFKIPIEELEDRIFVNGNTSIYRASSLSNCRHTSSVEE

SEQ ID NO: 1610 - protein, 42 aa, Artificial Sequence
  chemically synthesized
SQVSPFKIPIEELEDRIFVNANTSIYRASSLSNCRHTSSVEE

SEQ ID NO: 1611 - protein, 42 aa, Artificial Sequence
  chemically synthesized
SQVSPFKIPIEELEDRIFVNCQTSIYRASSLSNCRHTSSVEE

SEQ ID NO: 1612 - protein, 42 aa, Artificial Sequence
  chemically synthesized
SQVSPFKIPIEELEDRIFVNCNSSIYRASSLSNCRHTSSVEE

SEQ ID NO: 1613 - protein, 42 aa, Artificial Sequence
  chemically synthesized
SQVSPFKIPIEELEDRIFVNCNYSIYRASSLSNCRHTSSVEE

SEQ ID NO: 1614 - protein, 42 aa, Artificial Sequence
  chemically synthesized
SQVSPFKIPIEELEDRIFVNCNTTIYRASSLSNCRHTSSVEE

SEQ ID NO: 1615 - protein, 42 aa, Artificial Sequence
  chemically synthesized
SQVSPFKIPIEELEDRIFVNCNTYIYRASSLSNCRHTSSVEE

SEQ ID NO: 1616 - protein, 42 aa, Artificial Sequence
  chemically synthesized
SQVSPFKIPIEELEDRIFVNCNTSVYRASSLSNCRHTSSVEE

SEQ ID NO: 1617 - protein, 42 aa, Artificial Sequence
  chemically synthesized
SQVSPFKIPIEELEDRIFVNCNTSLYRASSLSNCRHTSSVEE

SEQ ID NO: 1618 - protein, 42 aa, Artificial Sequence
  chemically synthesized
SQVSPFKIPIEELEDRIFVNCNTSHYRASSLSNCRHTSSVEE

SEQ ID NO: 1619 - protein, 42 aa, Artificial Sequence
  chemically synthesized
SQVSPFKIPIEELEDRIFVNCNTSFYRASSLSNCRHTSSVEE

SEQ ID NO: 1620 - protein, 42 aa, Artificial Sequence
  chemically synthesized
SQVSPFKIPIEELEDRIFVNCNTSMYRASSLSNCRHTSSVEE

SEQ ID NO: 1621 - protein, 42 aa, Artificial Sequence
  chemically synthesized
SQVSPFKIPIEELEDRIFVNCNTSIWRASSLSNCRHTSSVEE

SEQ ID NO: 1622 - protein, 42 aa, Artificial Sequence
  chemically synthesized
SQVSPFKIPIEELEDRIFVNCNTSIFRASSLSNCRHTSSVEE

SEQ ID NO: 1623 - protein, 42 aa, Artificial Sequence
  chemically synthesized
SQVSPFKIPIEELEDRIFVNCNTSISRASSLSNCRHTSSVEE

SEQ ID NO: 1624 - protein, 42 aa, Artificial Sequence
  chemically synthesized
SQVSPFKIPIEELEDRIFVNCNTSITRASSLSNCRHTSSVEE

SEQ ID NO: 1625 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRIFVNCNTSIYXASSLSNCRHTSSVEE

SEQ ID NO: 1626 - protein, 42 aa, Artificial Sequence
  chemically synthesized
SQVSPFKIPIEELEDRIFVNCNTSIYHASSLSNCRHTSSVEE

SEQ ID NO: 1627 - protein, 42 aa, Artificial Sequence
  chemically synthesized
SQVSPFKIPIEELEDRIFVNCNTSIYKASSLSNCRHTSSVEE

SEQ ID NO: 1628 - protein, 42 aa, Artificial Sequence
  chemically synthesized
SQVSPFKIPIEELEDRIFVNCNTSIYRGSSLSNCRHTSSVEE

SEQ ID NO: 1629 - protein, 42 aa, Artificial Sequence
  chemically synthesized
SQVSPFKIPIEELEDRIFVNCNTSIYRATSLSNCRHTSSVEE

SEQ ID NO: 1630 - protein, 42 aa, Artificial Sequence
  chemically synthesized
SQVSPFKIPIEELEDRIFVNCNTSIYRAYSLSNCRHTSSVEE

SEQ ID NO: 1631 - protein, 42 aa, Artificial Sequence
  chemically synthesized
SQVSPFKIPIEELEDRIFVNCNTSIYRASTLSNCRHTSSVEE

SEQ ID NO: 1632 - protein, 42 aa, Artificial Sequence
  chemically synthesized
SQVSPFKIPIEELEDRIFVNCNTSIYRASYLSNCRHTSSVEE

SEQ ID NO: 1633 - protein, 42 aa, Artificial Sequence
  chemically synthesized
SQVSPFKIPIEELEDRIFVNCNTSIYRASSISNCRHTSSVEE

SEQ ID NO: 1634 - protein, 42 aa, Artificial Sequence
  chemically synthesized
SQVSPFKIPIEELEDRIFVNCNTSIYRASSVSNCRHTSSVEE

SEQ ID NO: 1635 - protein, 42 aa, Artificial Sequence
  chemically synthesized
SQVSPFKIPIEELEDRIFVNCNTSIYRASSFSNCRHTSSVEE

SEQ ID NO: 1636 - protein, 42 aa, Artificial Sequence
  chemically synthesized
SQVSPFKIPIEELEDRIFVNCNTSIYRASSMSNCRHTSSVEE

SEQ ID NO: 1637 - protein, 42 aa, Artificial Sequence
  chemically synthesized
SQVSPFKIPIEELEDRIFVNCNTSIYRASSHSNCRHTSSVEE

SEQ ID NO: 1638 - protein, 42 aa, Artificial Sequence
  chemically synthesized
SQVSPFKIPIEELEDRIFVNCNTSIYRASSLTNCRHTSSVEE

SEQ ID NO: 1639 - protein, 42 aa, Artificial Sequence
  chemically synthesized
SQVSPFKIPIEELEDRIFVNCNTSIYRASSLYNCRHTSSVEE

SEQ ID NO: 1640 - protein, 42 aa, Artificial Sequence
  chemically synthesized
SQVSPFKIPIEELEDRIFVNCNTSIYRASSLSQCRHTSSVEE

SEQ ID NO: 1641 - protein, 42 aa, Artificial Sequence
  chemically synthesized
SQVSPFKIPIEELEDRIFVNCNTSIYRASSLSNSRHTSSVEE

SEQ ID NO: 1642 - protein, 42 aa, Artificial Sequence
  chemically synthesized
SQVSPFKIPIEELEDRIFVNCNTSIYRASSLSNGRHTSSVEE

SEQ ID NO: 1643 - protein, 42 aa, Artificial Sequence
  chemically synthesized
SQVSPFKIPIEELEDRIFVNCNTSIYRASSLSNARHTSSVEE

SEQ ID NO: 1644 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRIFVNCNTSIYRASSLSNCXHTSSVEE

SEQ ID NO: 1645 - protein, 42 aa, Artificial Sequence
  chemically synthesized
SQVSPFKIPIEELEDRIFVNCNTSIYRASSLSNCHHTSSVEE

SEQ ID NO: 1646 - protein, 42 aa, Artificial Sequence
  chemically synthesized
SQVSPFKIPIEELEDRIFVNCNTSIYRASSLSNCKHTSSVEE

SEQ ID NO: 1647 - protein, 42 aa, Artificial Sequence
  chemically synthesized
SQVSPFKIPIEELEDRIFVNCNTSIYRASSLSNCRGTSSVEE

SEQ ID NO: 1648 - protein, 42 aa, Artificial Sequence
  chemically synthesized
SQVSPFKIPIEELEDRIFVNCNTSIYRASSLSNCRATSSVEE

SEQ ID NO: 1649 - protein, 42 aa, Artificial Sequence
  chemically synthesized
SQVSPFKIPIEELEDRIFVNCNTSIYRASSLSNCRITSSVEE

SEQ ID NO: 1650 - protein, 42 aa, Artificial Sequence
  chemically synthesized
SQVSPFKIPIEELEDRIFVNCNTSIYRASSLSNCRLTSSVEE

SEQ ID NO: 1651 - protein, 42 aa, Artificial Sequence
  chemically synthesized
SQVSPFKIPIEELEDRIFVNCNTSIYRASSLSNCRMTSSVEE

SEQ ID NO: 1652 - protein, 42 aa, Artificial Sequence
  chemically synthesized
SQVSPFKIPIEELEDRIFVNCNTSIYRASSLSNCRVTSSVEE

SEQ ID NO: 1653 - protein, 42 aa, Artificial Sequence
  chemically synthesized
SQVSPFKIPIEELEDRIFVNCNTSIYRASSLSNCRHSSSVEE

SEQ ID NO: 1654 - protein, 42 aa, Artificial Sequence
  chemically synthesized
SQVSPFKIPIEELEDRIFVNCNTSIYRASSLSNCRHYSSVEE

SEQ ID NO: 1655 - protein, 42 aa, Artificial Sequence
  chemically synthesized
SQVSPFKIPIEELEDRIFVNCNTSIYRASSLSNCRHTTSVEE

SEQ ID NO: 1656 - protein, 42 aa, Artificial Sequence
  chemically synthesized
SQVSPFKIPIEELEDRIFVNCNTSIYRASSLSNCRHTYSVEE

SEQ ID NO: 1657 - protein, 42 aa, Artificial Sequence
  chemically synthesized
SQVSPFKIPIEELEDRIFVNCNTSIYRASSLSNCRHTSTVEE

SEQ ID NO: 1658 - protein, 42 aa, Artificial Sequence
  chemically synthesized
SQVSPFKIPIEELEDRIFVNCNTSIYRASSLSNCRHTSYVEE

SEQ ID NO: 1659 - protein, 42 aa, Artificial Sequence
  chemically synthesized
SQVSPFKIPIEELEDRIFVNCNTSIYRASSLSNCRHTSSIEE

SEQ ID NO: 1660 - protein, 42 aa, Artificial Sequence
  chemically synthesized
SQVSPFKIPIEELEDRIFVNCNTSIYRASSLSNCRHTSSLEE

SEQ ID NO: 1661 - protein, 42 aa, Artificial Sequence
  chemically synthesized
SQVSPFKIPIEELEDRIFVNCNTSIYRASSLSNCRHTSSFEE

SEQ ID NO: 1662 - protein, 42 aa, Artificial Sequence
  chemically synthesized
SQVSPFKIPIEELEDRIFVNCNTSIYRASSLSNCRHTSSHEE

SEQ ID NO: 1663 - protein, 42 aa, Artificial Sequence
  chemically synthesized
SQVSPFKIPIEELEDRIFVNCNTSIYRASSLSNCRHTSSMEE

SEQ ID NO: 1664 - protein, 42 aa, Artificial Sequence
  chemically synthesized
SQVSPFKIPIEELEDRIFVNCNTSIYRASSLSNCRHTSSVDE

SEQ ID NO: 1665 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRIFVNCNTSIYRASSLSNCRHTSSVXE

SEQ ID NO: 1666 - protein, 42 aa, Artificial Sequence
  chemically synthesized
SQVSPFKIPIEELEDRIFVNCNTSIYRASSLSNCRHTSSVED

SEQ ID NO: 1667 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRIFVNCNTSIYRASSLSNCRHTSSVEX

SEQ ID NO: 1668 - protein, 42 aa, Artificial Sequence
  chemically synthesized
SQVSAFKIPIEELEDRIFVNCNTSIYRASSLSNCRHTSSVEE

SEQ ID NO: 1669 - protein, 42 aa, Artificial Sequence
  chemically synthesized
SQVSGFKIPIEELEDRIFVNCNTSIYRASSLSNCRHTSSVEE

SEQ ID NO: 1670 - protein, 42 aa, Artificial Sequence
  chemically synthesized
SQVSPFKIAIEELEDRIFVNCNTSIYRASSLSNCRHTSSVEE

SEQ ID NO: 1671 - protein, 42 aa, Artificial Sequence
  chemically synthesized
SQVSPFKIGIEELEDRIFVNCNTSIYRASSLSNCRHTSSVEE

SEQ ID NO: 1672 - protein, 42 aa, Artificial Sequence; identical to SEQ ID NO: 51
  chemically synthesized

SEQ ID NO: 1673 - protein, 42 aa, Artificial Sequence; identical to SEQ ID NO: 170
  chemically synthesized

SEQ ID NO: 1674 - protein, 42 aa, Artificial Sequence
  chemically synthesized
YQVSPFKIPIEELEDRVIVNCNTSIYRASSLSNCRHTSSVEE

SEQ ID NO: 1675 - protein, 42 aa, Artificial Sequence; identical to SEQ ID NO: 290
  chemically synthesized

SEQ ID NO: 1676 - protein, 42 aa, Artificial Sequence; identical to SEQ ID NO: 408
  chemically synthesized

SEQ ID NO: 1677 - protein, 42 aa, Artificial Sequence
  chemically synthesized
SQISPFKIPIEELEDRVIVNCNTSIYRASSLSNCRHTSSVEE

SEQ ID NO: 1678 - protein, 42 aa, Artificial Sequence
  chemically synthesized
SQPSPFKIPIEELEDRVIVNCNTSIYRASSLSNCRHTSSVEE

SEQ ID NO: 1679 - protein, 42 aa, Artificial Sequence
  chemically synthesized
SQFSPFKIPIEELEDRVIVNCNTSIYRASSLSNCRHTSSVEE

SEQ ID NO: 1680 - protein, 42 aa, Artificial Sequence; identical to SEQ ID NO: 527
  chemically synthesized

SEQ ID NO: 1681 - protein, 42 aa, Artificial Sequence
  chemically synthesized
SQVYPFKIPIEELEDRVIVNCNTSIYRASSLSNCRHTSSVEE

SEQ ID NO: 1682 - protein, 42 aa, Artificial Sequence
  chemically synthesized
SQVSPWKIPIEELEDRVIVNCNTSIYRASSLSNCRHTSSVEE

SEQ ID NO: 1683 - protein, 42 aa, Artificial Sequence
  chemically synthesized
SQVSPYKIPIEELEDRVIVNCNTSIYRASSLSNCRHTSSVEE

SEQ ID NO: 1684 - protein, 42 aa, Artificial Sequence
  chemically synthesized
SQVSPHKIPIEELEDRVIVNCNTSIYRASSLSNCRHTSSVEE

SEQ ID NO: 1685 - protein, 42 aa, Artificial Sequence
  chemically synthesized
SQVSPFRIPIEELEDRVIVNCNTSIYRASSLSNCRHTSSVEE

SEQ ID NO: 1686 - protein, 42 aa, Artificial Sequence
  chemically synthesized
SQVSPFHIPIEELEDRVIVNCNTSIYRASSLSNCRHTSSVEE

SEQ ID NO: 1687 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVIVNCNTSIYRASSLSNCRHTSSVEE

SEQ ID NO: 1688 - protein, 42 aa, Artificial Sequence; identical to SEQ ID NO: 766
  chemically synthesized

SEQ ID NO: 1689 - protein, 42 aa, Artificial Sequence
  chemically synthesized
SQVSPFKHPIEELEDRVIVNCNTSIYRASSLSNCRHTSSVEE

SEQ ID NO: 1690 - protein, 42 aa, Artificial Sequence
  chemically synthesized
SQVSPFKVPIEELEDRVIVNCNTSIYRASSLSNCRHTSSVEE

SEQ ID NO: 1691 - protein, 42 aa, Artificial Sequence
  chemically synthesized
SQVSPFKFPIEELEDRVIVNCNTSIYRASSLSNCRHTSSVEE

SEQ ID NO: 1692 - protein, 42 aa, Artificial Sequence
  chemically synthesized
SQVSPFKMPIEELEDRVIVNCNTSIYRASSLSNCRHTSSVEE

SEQ ID NO: 1693 - protein, 42 aa, Artificial Sequence; identical to SEQ ID NO: 884
  chemically synthesized

SEQ ID NO: 1694 - protein, 42 aa, Artificial Sequence
  chemically synthesized
SQVSPFKIPHEELEDRVIVNCNTSIYRASSLSNCRHTSSVEE

SEQ ID NO: 1695 - protein, 42 aa, Artificial Sequence
  chemically synthesized
SQVSPFKIPVEELEDRVIVNCNTSIYRASSLSNCRHTSSVEE

SEQ ID NO: 1696 - protein, 42 aa, Artificial Sequence
  chemically synthesized
SQVSPFKIPFEELEDRVIVNCNTSIYRASSLSNCRHTSSVEE

SEQ ID NO: 1697 - protein, 42 aa, Artificial Sequence
  chemically synthesized
SQVSPFKIPMEELEDRVIVNCNTSIYRASSLSNCRHTSSVEE

SEQ ID NO: 1698 - protein, 42 aa, Artificial Sequence; identical to SEQ ID NO: 1004
  chemically synthesized

SEQ ID NO: 1699 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVIVNCNTSIYRASSLSNCRHTSSVEE

SEQ ID NO: 1700 - protein, 42 aa, Artificial Sequence; identical to SEQ ID NO: 1124
  chemically synthesized

SEQ ID NO: 1701 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVIVNCNTSIYRASSLSNCRHTSSVEE

SEQ ID NO: 1702 - protein, 42 aa, Artificial Sequence
  chemically synthesized
SQVSPFKIPIEEVEDRVIVNCNTSIYRASSLSNCRHTSSVEE

SEQ ID NO: 1703 - protein, 42 aa, Artificial Sequence; identical to SEQ ID NO: 1241
  chemically synthesized

SEQ ID NO: 1704 - protein, 42 aa, Artificial Sequence
  chemically synthesized
SQVSPFKIPIEEFEDRVIVNCNTSIYRASSLSNCRHTSSVEE

SEQ ID NO: 1705 - protein, 42 aa, Artificial Sequence
  chemically synthesized
SQVSPFKIPIEEHEDRVIVNCNTSIYRASSLSNCRHTSSVEE

SEQ ID NO: 1706 - protein, 42 aa, Artificial Sequence
  chemically synthesized
SQVSPFKIPIEEMEDRVIVNCNTSIYRASSLSNCRHTSSVEE

SEQ ID NO: 1707 - protein, 42 aa, Artificial Sequence; identical to SEQ ID NO: 1361
  chemically synthesized

SEQ ID NO: 1708 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVIVNCNTSIYRASSLSNCRHTSSVEE

SEQ ID NO: 1709 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVIVNCNTSIYRASSLSNCRHTSSVEE

SEQ ID NO: 1710 - protein, 42 aa, Artificial Sequence
  chemically synthesized
SQVSPFKIPIEELEERVIVNCNTSIYRASSLSNCRHTSSVEE

SEQ ID NO: 1711 - protein, 42 aa, Artificial Sequence; identical to SEQ ID NO: 1480
  chemically synthesized

SEQ ID NO: 1712 - protein, 42 aa, Artificial Sequence
  chemically synthesized
SQVSPFKIPIEELEDHVIVNCNTSIYRASSLSNCRHTSSVEE

SEQ ID NO: 1713 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVIVNCNTSIYRASSLSNCRHTSSVEE

SEQ ID NO: 1714 - protein, 42 aa, Artificial Sequence; identical to SEQ ID NO: 1597
  chemically synthesized

SEQ ID NO: 1715 - protein, 42 aa, Artificial Sequence
  chemically synthesized
SQVSPFKIPIEELEDRLIVNCNTSIYRASSLSNCRHTSSVEE

SEQ ID NO: 1716 - protein, 42 aa, Artificial Sequence
  chemically synthesized
SQVSPFKIPIEELEDRFIVNCNTSIYRASSLSNCRHTSSVEE

SEQ ID NO: 1717 - protein, 42 aa, Artificial Sequence
  chemically synthesized
SQVSPFKIPIEELEDRHIVNCNTSIYRASSLSNCRHTSSVEE

SEQ ID NO: 1718 - protein, 42 aa, Artificial Sequence
  chemically synthesized
SQVSPFKIPIEELEDRMIVNCNTSIYRASSLSNCRHTSSVEE

SEQ ID NO: 1719 - protein, 42 aa, Artificial Sequence
  chemically synthesized
SQVSPFKIPIEELEDRVIINCNTSIYRASSLSNCRHTSSVEE

SEQ ID NO: 1720 - protein, 42 aa, Artificial Sequence
  chemically synthesized
SQVSPFKIPIEELEDRVILNCNTSIYRASSLSNCRHTSSVEE

SEQ ID NO: 1721 - protein, 42 aa, Artificial Sequence
  chemically synthesized
SQVSPFKIPIEELEDRVIFNCNTSIYRASSLSNCRHTSSVEE

SEQ ID NO: 1722 - protein, 42 aa, Artificial Sequence
  chemically synthesized
SQVSPFKIPIEELEDRVIHNCNTSIYRASSLSNCRHTSSVEE

SEQ ID NO: 1723 - protein, 42 aa, Artificial Sequence
  chemically synthesized
SQVSPFKIPIEELEDRVIMNCNTSIYRASSLSNCRHTSSVEE

SEQ ID NO: 1724 - protein, 42 aa, Artificial Sequence
  chemically synthesized
SQVSPFKIPIEELEDRVIVQCNTSIYRASSLSNCRHTSSVEE

SEQ ID NO: 1725 - protein, 42 aa, Artificial Sequence
  chemically synthesized
SQVSPFKIPIEELEDRVIVNSNTSIYRASSLSNCRHTSSVEE

SEQ ID NO: 1726 - protein, 42 aa, Artificial Sequence
  chemically synthesized
SQVSPFKIPIEELEDRVIVNGNTSIYRASSLSNCRHTSSVEE

SEQ ID NO: 1727 - protein, 42 aa, Artificial Sequence
  chemically synthesized
SQVSPFKIPIEELEDRVIVNANTSIYRASSLSNCRHTSSVEE

SEQ ID NO: 1728 - protein, 42 aa, Artificial Sequence
  chemically synthesized
SQVSPFKIPIEELEDRVIVNCQTSIYRASSLSNCRHTSSVEE

SEQ ID NO: 1729 - protein, 42 aa, Artificial Sequence
  chemically synthesized
SQVSPFKIPIEELEDRVIVNCNSSIYRASSLSNCRHTSSVEE

SEQ ID NO: 1730 - protein, 42 aa, Artificial Sequence
  chemically synthesized
SQVSPFKIPIEELEDRVIVNCNYSIYRASSLSNCRHTSSVEE

SEQ ID NO: 1731 - protein, 42 aa, Artificial Sequence
  chemically synthesized
SQVSPFKIPIEELEDRVIVNCNTTIYRASSLSNCRHTSSVEE

SEQ ID NO: 1732 - protein, 42 aa, Artificial Sequence
  chemically synthesized
SQVSPFKIPIEELEDRVIVNCNTYIYRASSLSNCRHTSSVEE

SEQ ID NO: 1733 - protein, 42 aa, Artificial Sequence
  chemically synthesized
SQVSPFKIPIEELEDRVIVNCNTSVYRASSLSNCRHTSSVEE

SEQ ID NO: 1734 - protein, 42 aa, Artificial Sequence
  chemically synthesized
SQVSPFKIPIEELEDRVIVNCNTSLYRASSLSNCRHTSSVEE

SEQ ID NO: 1735 - protein, 42 aa, Artificial Sequence
  chemically synthesized
SQVSPFKIPIEELEDRVIVNCNTSHYRASSLSNCRHTSSVEE

SEQ ID NO: 1736 - protein, 42 aa, Artificial Sequence
  chemically synthesized
SQVSPFKIPIEELEDRVIVNCNTSFYRASSLSNCRHTSSVEE

SEQ ID NO: 1737 - protein, 42 aa, Artificial Sequence
  chemically synthesized
SQVSPFKIPIEELEDRVIVNCNTSMYRASSLSNCRHTSSVEE

SEQ ID NO: 1738 - protein, 42 aa, Artificial Sequence
  chemically synthesized
SQVSPFKIPIEELEDRVIVNCNTSIWRASSLSNCRHTSSVEE

SEQ ID NO: 1739 - protein, 42 aa, Artificial Sequence
  chemically synthesized
SQVSPFKIPIEELEDRVIVNCNTSIFRASSLSNCRHTSSVEE

SEQ ID NO: 1740 - protein, 42 aa, Artificial Sequence
  chemically synthesized
SQVSPFKIPIEELEDRVIVNCNTSISRASSLSNCRHTSSVEE

SEQ ID NO: 1741 - protein, 42 aa, Artificial Sequence
  chemically synthesized
SQVSPFKIPIEELEDRVIVNCNTSITRASSLSNCRHTSSVEE

SEQ ID NO: 1742 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVIVNCNTSIYXASSLSNCRHTSSVEE

SEQ ID NO: 1743 - protein, 42 aa, Artificial Sequence
  chemically synthesized
SQVSPFKIPIEELEDRVIVNCNTSIYHASSLSNCRHTSSVEE

SEQ ID NO: 1744 - protein, 42 aa, Artificial Sequence
  chemically synthesized
SQVSPFKIPIEELEDRVIVNCNTSIYKASSLSNCRHTSSVEE

SEQ ID NO: 1745 - protein, 42 aa, Artificial Sequence
  chemically synthesized
SQVSPFKIPIEELEDRVIVNCNTSIYRGSSLSNCRHTSSVEE

SEQ ID NO: 1746 - protein, 42 aa, Artificial Sequence
  chemically synthesized
SQVSPFKIPIEELEDRVIVNCNTSIYRATSLSNCRHTSSVEE

SEQ ID NO: 1747 - protein, 42 aa, Artificial Sequence
  chemically synthesized
SQVSPFKIPIEELEDRVIVNCNTSIYRAYSLSNCRHTSSVEE

SEQ ID NO: 1748 - protein, 42 aa, Artificial Sequence
  chemically synthesized
SQVSPFKIPIEELEDRVIVNCNTSIYRASTLSNCRHTSSVEE

SEQ ID NO: 1749 - protein, 42 aa, Artificial Sequence
  chemically synthesized
SQVSPFKIPIEELEDRVIVNCNTSIYRASYLSNCRHTSSVEE

SEQ ID NO: 1750 - protein, 42 aa, Artificial Sequence
  chemically synthesized
SQVSPFKIPIEELEDRVIVNCNTSIYRASSISNCRHTSSVEE

SEQ ID NO: 1751 - protein, 42 aa, Artificial Sequence
  chemically synthesized
SQVSPFKIPIEELEDRVIVNCNTSIYRASSVSNCRHTSSVEE

SEQ ID NO: 1752 - protein, 42 aa, Artificial Sequence
  chemically synthesized
SQVSPFKIPIEELEDRVIVNCNTSIYRASSFSNCRHTSSVEE

SEQ ID NO: 1753 - protein, 42 aa, Artificial Sequence
  chemically synthesized
SQVSPFKIPIEELEDRVIVNCNTSIYRASSMSNCRHTSSVEE

SEQ ID NO: 1754 - protein, 42 aa, Artificial Sequence
  chemically synthesized
SQVSPFKIPIEELEDRVIVNCNTSIYRASSHSNCRHTSSVEE

SEQ ID NO: 1755 - protein, 42 aa, Artificial Sequence
  chemically synthesized
SQVSPFKIPIEELEDRVIVNCNTSIYRASSLTNCRHTSSVEE

SEQ ID NO: 1756 - protein, 42 aa, Artificial Sequence
  chemically synthesized
SQVSPFKIPIEELEDRVIVNCNTSIYRASSLYNCRHTSSVEE

SEQ ID NO: 1757 - protein, 42 aa, Artificial Sequence
  chemically synthesized
SQVSPFKIPIEELEDRVIVNCNTSIYRASSLSQCRHTSSVEE

SEQ ID NO: 1758 - protein, 42 aa, Artificial Sequence
  chemically synthesized
SQVSPFKIPIEELEDRVIVNCNTSIYRASSLSNSRHTSSVEE

SEQ ID NO: 1759 - protein, 42 aa, Artificial Sequence
  chemically synthesized
SQVSPFKIPIEELEDRVIVNCNTSIYRASSLSNGRHTSSVEE

SEQ ID NO: 1760 - protein, 42 aa, Artificial Sequence
  chemically synthesized
SQVSPFKIPIEELEDRVIVNCNTSIYRASSLSNARHTSSVEE

SEQ ID NO: 1761 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVIVNCNTSIYRASSLSNCXHTSSVEE

SEQ ID NO: 1762 - protein, 42 aa, Artificial Sequence
  chemically synthesized
SQVSPFKIPIEELEDRVIVNCNTSIYRASSLSNCHHTSSVEE

SEQ ID NO: 1763 - protein, 42 aa, Artificial Sequence
  chemically synthesized
SQVSPFKIPIEELEDRVIVNCNTSIYRASSLSNCKHTSSVEE

SEQ ID NO: 1764 - protein, 42 aa, Artificial Sequence
  chemically synthesized
SQVSPFKIPIEELEDRVIVNCNTSIYRASSLSNCRGTSSVEE

SEQ ID NO: 1765 - protein, 42 aa, Artificial Sequence
  chemically synthesized
SQVSPFKIPIEELEDRVIVNCNTSIYRASSLSNCRATSSVEE

SEQ ID NO: 1766 - protein, 42 aa, Artificial Sequence
  chemically synthesized
SQVSPFKIPIEELEDRVIVNCNTSIYRASSLSNCRITSSVEE

SEQ ID NO: 1767 - protein, 42 aa, Artificial Sequence
  chemically synthesized
SQVSPFKIPIEELEDRVIVNCNTSIYRASSLSNCRLTSSVEE

SEQ ID NO: 1768 - protein, 42 aa, Artificial Sequence
  chemically synthesized
SQVSPFKIPIEELEDRVIVNCNTSIYRASSLSNCRMTSSVEE

SEQ ID NO: 1769 - protein, 42 aa, Artificial Sequence
  chemically synthesized
SQVSPFKIPIEELEDRVIVNCNTSIYRASSLSNCRVTSSVEE

SEQ ID NO: 1770 - protein, 42 aa, Artificial Sequence
  chemically synthesized
SQVSPFKIPIEELEDRVIVNCNTSIYRASSLSNCRHSSSVEE

SEQ ID NO: 1771 - protein, 42 aa, Artificial Sequence
  chemically synthesized
SQVSPFKIPIEELEDRVIVNCNTSIYRASSLSNCRHYSSVEE

SEQ ID NO: 1772 - protein, 42 aa, Artificial Sequence
  chemically synthesized
SQVSPFKIPIEELEDRVIVNCNTSIYRASSLSNCRHTTSVEE

SEQ ID NO: 1773 - protein, 42 aa, Artificial Sequence
  chemically synthesized
SQVSPFKIPIEELEDRVIVNCNTSIYRASSLSNCRHTYSVEE

SEQ ID NO: 1774 - protein, 42 aa, Artificial Sequence
  chemically synthesized
SQVSPFKIPIEELEDRVIVNCNTSIYRASSLSNCRHTSTVEE

SEQ ID NO: 1775 - protein, 42 aa, Artificial Sequence
  chemically synthesized
SQVSPFKIPIEELEDRVIVNCNTSIYRASSLSNCRHTSYVEE

SEQ ID NO: 1776 - protein, 42 aa, Artificial Sequence
  chemically synthesized
SQVSPFKIPIEELEDRVIVNCNTSIYRASSLSNCRHTSSIEE

SEQ ID NO: 1777 - protein, 42 aa, Artificial Sequence
  chemically synthesized
SQVSPFKIPIEELEDRVIVNCNTSIYRASSLSNCRHTSSLEE

SEQ ID NO: 1778 - protein, 42 aa, Artificial Sequence
  chemically synthesized
SQVSPFKIPIEELEDRVIVNCNTSIYRASSLSNCRHTSSFEE

SEQ ID NO: 1779 - protein, 42 aa, Artificial Sequence
  chemically synthesized
SQVSPFKIPIEELEDRVIVNCNTSIYRASSLSNCRHTSSHEE

SEQ ID NO: 1780 - protein, 42 aa, Artificial Sequence
  chemically synthesized
SQVSPFKIPIEELEDRVIVNCNTSIYRASSLSNCRHTSSMEE

SEQ ID NO: 1781 - protein, 42 aa, Artificial Sequence
  chemically synthesized
SQVSPFKIPIEELEDRVIVNCNTSIYRASSLSNCRHTSSVDE

SEQ ID NO: 1782 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVIVNCNTSIYRASSLSNCRHTSSVXE

SEQ ID NO: 1783 - protein, 42 aa, Artificial Sequence
  chemically synthesized
SQVSPFKIPIEELEDRVIVNCNTSIYRASSLSNCRHTSSVED

SEQ ID NO: 1784 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVIVNCNTSIYRASSLSNCRHTSSVEX

SEQ ID NO: 1785 - protein, 42 aa, Artificial Sequence
  chemically synthesized
SQVSAFKIPIEELEDRVIVNCNTSIYRASSLSNCRHTSSVEE

SEQ ID NO: 1786 - protein, 42 aa, Artificial Sequence
  chemically synthesized
SQVSGFKIPIEELEDRVIVNCNTSIYRASSLSNCRHTSSVEE

SEQ ID NO: 1787 - protein, 42 aa, Artificial Sequence
  chemically synthesized
SQVSPFKIAIEELEDRVIVNCNTSIYRASSLSNCRHTSSVEE

SEQ ID NO: 1788 - protein, 42 aa, Artificial Sequence
  chemically synthesized
SQVSPFKIGIEELEDRVIVNCNTSIYRASSLSNCRHTSSVEE

SEQ ID NO: 1789 - protein, 42 aa, Artificial Sequence; identical to SEQ ID NO: 56
  chemically synthesized

SEQ ID NO: 1790 - protein, 42 aa, Artificial Sequence; identical to SEQ ID NO: 175
  chemically synthesized

SEQ ID NO: 1791 - protein, 42 aa, Artificial Sequence
  chemically synthesized
YQVSPFKIPIEELEDRVFINCNTSIYRASSLSNCRHTSSVEE

SEQ ID NO: 1792 - protein, 42 aa, Artificial Sequence; identical to SEQ ID NO: 295
  chemically synthesized

SEQ ID NO: 1793 - protein, 42 aa, Artificial Sequence; identical to SEQ ID NO: 413
  chemically synthesized

SEQ ID NO: 1794 - protein, 42 aa, Artificial Sequence
  chemically synthesized
SQISPFKIPIEELEDRVFINCNTSIYRASSLSNCRHTSSVEE

SEQ ID NO: 1795 - protein, 42 aa, Artificial Sequence
  chemically synthesized
SQPSPFKIPIEELEDRVFINCNTSIYRASSLSNCRHTSSVEE

SEQ ID NO: 1796 - protein, 42 aa, Artificial Sequence
  chemically synthesized
SQFSPFKIPIEELEDRVFINCNTSIYRASSLSNCRHTSSVEE

SEQ ID NO: 1797 - protein, 42 aa, Artificial Sequence; identical to SEQ ID NO: 532
  chemically synthesized

SEQ ID NO: 1798 - protein, 42 aa, Artificial Sequence
  chemically synthesized
SQVYPFKIPIEELEDRVFINCNTSIYRASSLSNCRHTSSVEE

SEQ ID NO: 1799 - protein, 42 aa, Artificial Sequence
  chemically synthesized
SQVSPWKIPIEELEDRVFINCNTSIYRASSLSNCRHTSSVEE

SEQ ID NO: 1800 - protein, 42 aa, Artificial Sequence
  chemically synthesized
SQVSPYKIPIEELEDRVFINCNTSIYRASSLSNCRHTSSVEE

SEQ ID NO: 1801 - protein, 42 aa, Artificial Sequence
  chemically synthesized
SQVSPHKIPIEELEDRVFINCNTSIYRASSLSNCRHTSSVEE

SEQ ID NO: 1802 - protein, 42 aa, Artificial Sequence
  chemically synthesized
SQVSPFRIPIEELEDRVFINCNTSIYRASSLSNCRHTSSVEE

SEQ ID NO: 1803 - protein, 42 aa, Artificial Sequence
  chemically synthesized
SQVSPFHIPIEELEDRVFINCNTSIYRASSLSNCRHTSSVEE

SEQ ID NO: 1804 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFINCNTSIYRASSLSNCRHTSSVEE

SEQ ID NO: 1805 - protein, 42 aa, Artificial Sequence; identical to SEQ ID NO: 771
  chemically synthesized

SEQ ID NO: 1806 - protein, 42 aa, Artificial Sequence
  chemically synthesized
SQVSPFKHPIEELEDRVFINCNTSIYRASSLSNCRHTSSVEE

SEQ ID NO: 1807 - protein, 42 aa, Artificial Sequence
  chemically synthesized
SQVSPFKVPIEELEDRVFINCNTSIYRASSLSNCRHTSSVEE

SEQ ID NO: 1808 - protein, 42 aa, Artificial Sequence
  chemically synthesized
SQVSPFKFPIEELEDRVFINCNTSIYRASSLSNCRHTSSVEE

SEQ ID NO: 1809 - protein, 42 aa, Artificial Sequence
  chemically synthesized
SQVSPFKMPIEELEDRVFINCNTSIYRASSLSNCRHTSSVEE

SEQ ID NO: 1810 - protein, 42 aa, Artificial Sequence; identical to SEQ ID NO: 889
  chemically synthesized

SEQ ID NO: 1811 - protein, 42 aa, Artificial Sequence
  chemically synthesized
SQVSPFKIPHEELEDRVFINCNTSIYRASSLSNCRHTSSVEE

SEQ ID NO: 1812 - protein, 42 aa, Artificial Sequence
  chemically synthesized
SQVSPFKIPVEELEDRVFINCNTSIYRASSLSNCRHTSSVEE

SEQ ID NO: 1813 - protein, 42 aa, Artificial Sequence
  chemically synthesized
SQVSPFKIPFEELEDRVFINCNTSIYRASSLSNCRHTSSVEE

SEQ ID NO: 1814 - protein, 42 aa, Artificial Sequence
  chemically synthesized
SQVSPFKIPMEELEDRVFINCNTSIYRASSLSNCRHTSSVEE

SEQ ID NO: 1815 - protein, 42 aa, Artificial Sequence; identical to SEQ ID NO: 1009
  chemically synthesized

SEQ ID NO: 1816 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFINCNTSIYRASSLSNCRHTSSVEE

SEQ ID NO: 1817 - protein, 42 aa, Artificial Sequence; identical to SEQ ID NO: 1129
  chemically synthesized

SEQ ID NO: 1818 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFINCNTSIYRASSLSNCRHTSSVEE

SEQ ID NO: 1819 - protein, 42 aa, Artificial Sequence
  chemically synthesized
SQVSPFKIPIEEVEDRVFINCNTSIYRASSLSNCRHTSSVEE

SEQ ID NO: 1820 - protein, 42 aa, Artificial Sequence; identical to SEQ ID NO: 1246
  chemically synthesized

SEQ ID NO: 1821 - protein, 42 aa, Artificial Sequence
  chemically synthesized
SQVSPFKIPIEEFEDRVFINCNTSIYRASSLSNCRHTSSVEE

SEQ ID NO: 1822 - protein, 42 aa, Artificial Sequence
  chemically synthesized
SQVSPFKIPIEEHEDRVFINCNTSIYRASSLSNCRHTSSVEE

SEQ ID NO: 1823 - protein, 42 aa, Artificial Sequence
  chemically synthesized
SQVSPFKIPIEEMEDRVFINCNTSIYRASSLSNCRHTSSVEE

SEQ ID NO: 1824 - protein, 42 aa, Artificial Sequence; identical to SEQ ID NO: 1366
  chemically synthesized

SEQ ID NO: 1825 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFINCNTSIYRASSLSNCRHTSSVEE

SEQ ID NO: 1826 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFINCNTSIYRASSLSNCRHTSSVEE

SEQ ID NO: 1827 - protein, 42 aa, Artificial Sequence
  chemically synthesized
SQVSPFKIPIEELEERVFINCNTSIYRASSLSNCRHTSSVEE

SEQ ID NO: 1828 - protein, 42 aa, Artificial Sequence; identical to SEQ ID NO: 1485
  chemically synthesized

SEQ ID NO: 1829 - protein, 42 aa, Artificial Sequence
  chemically synthesized
SQVSPFKIPIEELEDHVFINCNTSIYRASSLSNCRHTSSVEE

SEQ ID NO: 1830 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFINCNTSIYRASSLSNCRHTSSVEE

SEQ ID NO: 1831 - protein, 42 aa, Artificial Sequence; identical to SEQ ID NO: 1602
  chemically synthesized

SEQ ID NO: 1832 - protein, 42 aa, Artificial Sequence
  chemically synthesized
SQVSPFKIPIEELEDRLFINCNTSIYRASSLSNCRHTSSVEE

SEQ ID NO: 1833 - protein, 42 aa, Artificial Sequence
  chemically synthesized
SQVSPFKIPIEELEDRFFINCNTSIYRASSLSNCRHTSSVEE

SEQ ID NO: 1834 - protein, 42 aa, Artificial Sequence
  chemically synthesized
SQVSPFKIPIEELEDRHFINCNTSIYRASSLSNCRHTSSVEE

SEQ ID NO: 1835 - protein, 42 aa, Artificial Sequence
  chemically synthesized
SQVSPFKIPIEELEDRMFINCNTSIYRASSLSNCRHTSSVEE

SEQ ID NO: 1836 - protein, 42 aa, Artificial Sequence; identical to SEQ ID NO: 1719
  chemically synthesized

SEQ ID NO: 1837 - protein, 42 aa, Artificial Sequence
  chemically synthesized
SQVSPFKIPIEELEDRVLINCNTSIYRASSLSNCRHTSSVEE

SEQ ID NO: 1838 - protein, 42 aa, Artificial Sequence
  chemically synthesized
SQVSPFKIPIEELEDRVVINCNTSIYRASSLSNCRHTSSVEE

SEQ ID NO: 1839 - protein, 42 aa, Artificial Sequence
  chemically synthesized
SQVSPFKIPIEELEDRVHINCNTSIYRASSLSNCRHTSSVEE

SEQ ID NO: 1840 - protein, 42 aa, Artificial Sequence
  chemically synthesized
SQVSPFKIPIEELEDRVMINCNTSIYRASSLSNCRHTSSVEE

SEQ ID NO: 1841 - protein, 42 aa, Artificial Sequence
  chemically synthesized
SQVSPFKIPIEELEDRVFIQCNTSIYRASSLSNCRHTSSVEE

SEQ ID NO: 1842 - protein, 42 aa, Artificial Sequence
  chemically synthesized
SQVSPFKIPIEELEDRVFINSNTSIYRASSLSNCRHTSSVEE

SEQ ID NO: 1843 - protein, 42 aa, Artificial Sequence
  chemically synthesized
SQVSPFKIPIEELEDRVFINGNTSIYRASSLSNCRHTSSVEE

SEQ ID NO: 1844 - protein, 42 aa, Artificial Sequence
  chemically synthesized
SQVSPFKIPIEELEDRVFINANTSIYRASSLSNCRHTSSVEE

SEQ ID NO: 1845 - protein, 42 aa, Artificial Sequence
  chemically synthesized
SQVSPFKIPIEELEDRVFINCQTSIYRASSLSNCRHTSSVEE

SEQ ID NO: 1846 - protein, 42 aa, Artificial Sequence
  chemically synthesized
SQVSPFKIPIEELEDRVFINCNSSIYRASSLSNCRHTSSVEE

SEQ ID NO: 1847 - protein, 42 aa, Artificial Sequence
  chemically synthesized
SQVSPFKIPIEELEDRVFINCNYSIYRASSLSNCRHTSSVEE

SEQ ID NO: 1848 - protein, 42 aa, Artificial Sequence
  chemically synthesized
SQVSPFKIPIEELEDRVFINCNTTIYRASSLSNCRHTSSVEE

SEQ ID NO: 1849 - protein, 42 aa, Artificial Sequence
  chemically synthesized
SQVSPFKIPIEELEDRVFINCNTYIYRASSLSNCRHTSSVEE

SEQ ID NO: 1850 - protein, 42 aa, Artificial Sequence
  chemically synthesized
SQVSPFKIPIEELEDRVFINCNTSVYRASSLSNCRHTSSVEE

SEQ ID NO: 1851 - protein, 42 aa, Artificial Sequence
  chemically synthesized
SQVSPFKIPIEELEDRVFINCNTSLYRASSLSNCRHTSSVEE

SEQ ID NO: 1852 - protein, 42 aa, Artificial Sequence
  chemically synthesized
SQVSPFKIPIEELEDRVFINCNTSHYRASSLSNCRHTSSVEE

SEQ ID NO: 1853 - protein, 42 aa, Artificial Sequence
  chemically synthesized
SQVSPFKIPIEELEDRVFINCNTSFYRASSLSNCRHTSSVEE

SEQ ID NO: 1854 - protein, 42 aa, Artificial Sequence
  chemically synthesized
SQVSPFKIPIEELEDRVFINCNTSMYRASSLSNCRHTSSVEE

SEQ ID NO: 1855 - protein, 42 aa, Artificial Sequence
  chemically synthesized
SQVSPFKIPIEELEDRVFINCNTSIWRASSLSNCRHTSSVEE

SEQ ID NO: 1856 - protein, 42 aa, Artificial Sequence
  chemically synthesized
SQVSPFKIPIEELEDRVFINCNTSIFRASSLSNCRHTSSVEE

SEQ ID NO: 1857 - protein, 42 aa, Artificial Sequence
  chemically synthesized
SQVSPFKIPIEELEDRVFINCNTSISRASSLSNCRHTSSVEE

SEQ ID NO: 1858 - protein, 42 aa, Artificial Sequence
  chemically synthesized
SQVSPFKIPIEELEDRVFINCNTSITRASSLSNCRHTSSVEE

SEQ ID NO: 1859 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFINCNTSIYXASSLSNCRHTSSVEE

SEQ ID NO: 1860 - protein, 42 aa, Artificial Sequence
  chemically synthesized
SQVSPFKIPIEELEDRVFINCNTSIYHASSLSNCRHTSSVEE

SEQ ID NO: 1861 - protein, 42 aa, Artificial Sequence
  chemically synthesized
SQVSPFKIPIEELEDRVFINCNTSIYKASSLSNCRHTSSVEE

SEQ ID NO: 1862 - protein, 42 aa, Artificial Sequence
  chemically synthesized
SQVSPFKIPIEELEDRVFINCNTSIYRGSSLSNCRHTSSVEE

SEQ ID NO: 1863 - protein, 42 aa, Artificial Sequence
  chemically synthesized
SQVSPFKIPIEELEDRVFINCNTSIYRATSLSNCRHTSSVEE

SEQ ID NO: 1864 - protein, 42 aa, Artificial Sequence
  chemically synthesized
SQVSPFKIPIEELEDRVFINCNTSIYRAYSLSNCRHTSSVEE

SEQ ID NO: 1865 - protein, 42 aa, Artificial Sequence
  chemically synthesized
SQVSPFKIPIEELEDRVFINCNTSIYRASTLSNCRHTSSVEE

SEQ ID NO: 1866 - protein, 42 aa, Artificial Sequence
  chemically synthesized
SQVSPFKIPIEELEDRVFINCNTSIYRASYLSNCRHTSSVEE

SEQ ID NO: 1867 - protein, 42 aa, Artificial Sequence
  chemically synthesized
SQVSPFKIPIEELEDRVFINCNTSIYRASSISNCRHTSSVEE

SEQ ID NO: 1868 - protein, 42 aa, Artificial Sequence
  chemically synthesized
SQVSPFKIPIEELEDRVFINCNTSIYRASSVSNCRHTSSVEE

SEQ ID NO: 1869 - protein, 42 aa, Artificial Sequence
  chemically synthesized
SQVSPFKIPIEELEDRVFINCNTSIYRASSFSNCRHTSSVEE

SEQ ID NO: 1870 - protein, 42 aa, Artificial Sequence
  chemically synthesized
SQVSPFKIPIEELEDRVFINCNTSIYRASSMSNCRHTSSVEE

SEQ ID NO: 1871 - protein, 42 aa, Artificial Sequence
  chemically synthesized
SQVSPFKIPIEELEDRVFINCNTSIYRASSHSNCRHTSSVEE

SEQ ID NO: 1872 - protein, 42 aa, Artificial Sequence
  chemically synthesized
SQVSPFKIPIEELEDRVFINCNTSIYRASSLTNCRHTSSVEE

SEQ ID NO: 1873 - protein, 42 aa, Artificial Sequence
  chemically synthesized
SQVSPFKIPIEELEDRVFINCNTSIYRASSLYNCRHTSSVEE

SEQ ID NO: 1874 - protein, 42 aa, Artificial Sequence
  chemically synthesized
SQVSPFKIPIEELEDRVFINCNTSIYRASSLSQCRHTSSVEE

SEQ ID NO: 1875 - protein, 42 aa, Artificial Sequence
  chemically synthesized
SQVSPFKIPIEELEDRVFINCNTSIYRASSLSNSRHTSSVEE

SEQ ID NO: 1876 - protein, 42 aa, Artificial Sequence
  chemically synthesized
SQVSPFKIPIEELEDRVFINCNTSIYRASSLSNGRHTSSVEE

SEQ ID NO: 1877 - protein, 42 aa, Artificial Sequence
  chemically synthesized
SQVSPFKIPIEELEDRVFINCNTSIYRASSLSNARHTSSVEE

SEQ ID NO: 1878 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFINCNTSIYRASSLSNCXHTSSVEE

SEQ ID NO: 1879 - protein, 42 aa, Artificial Sequence
  chemically synthesized
SQVSPFKIPIEELEDRVFINCNTSIYRASSLSNCHHTSSVEE

SEQ ID NO: 1880 - protein, 42 aa, Artificial Sequence
  chemically synthesized
SQVSPFKIPIEELEDRVFINCNTSIYRASSLSNCKHTSSVEE

SEQ ID NO: 1881 - protein, 42 aa, Artificial Sequence
  chemically synthesized
SQVSPFKIPIEELEDRVFINCNTSIYRASSLSNCRGTSSVEE

SEQ ID NO: 1882 - protein, 42 aa, Artificial Sequence
  chemically synthesized
SQVSPFKIPIEELEDRVFINCNTSIYRASSLSNCRATSSVEE

SEQ ID NO: 1883 - protein, 42 aa, Artificial Sequence
  chemically synthesized
SQVSPFKIPIEELEDRVFINCNTSIYRASSLSNCRITSSVEE

SEQ ID NO: 1884 - protein, 42 aa, Artificial Sequence
  chemically synthesized
SQVSPFKIPIEELEDRVFINCNTSIYRASSLSNCRLTSSVEE

SEQ ID NO: 1885 - protein, 42 aa, Artificial Sequence
  chemically synthesized
SQVSPFKIPIEELEDRVFINCNTSIYRASSLSNCRMTSSVEE

SEQ ID NO: 1886 - protein, 42 aa, Artificial Sequence
  chemically synthesized
SQVSPFKIPIEELEDRVFINCNTSIYRASSLSNCRVTSSVEE

SEQ ID NO: 1887 - protein, 42 aa, Artificial Sequence
  chemically synthesized
SQVSPFKIPIEELEDRVFINCNTSIYRASSLSNCRHSSSVEE

SEQ ID NO: 1888 - protein, 42 aa, Artificial Sequence
  chemically synthesized
SQVSPFKIPIEELEDRVFINCNTSIYRASSLSNCRHYSSVEE

SEQ ID NO: 1889 - protein, 42 aa, Artificial Sequence
  chemically synthesized
SQVSPFKIPIEELEDRVFINCNTSIYRASSLSNCRHTTSVEE

SEQ ID NO: 1890 - protein, 42 aa, Artificial Sequence
  chemically synthesized
SQVSPFKIPIEELEDRVFINCNTSIYRASSLSNCRHTYSVEE

SEQ ID NO: 1891 - protein, 42 aa, Artificial Sequence
  chemically synthesized
SQVSPFKIPIEELEDRVFINCNTSIYRASSLSNCRHTSTVEE

SEQ ID NO: 1892 - protein, 42 aa, Artificial Sequence
  chemically synthesized
SQVSPFKIPIEELEDRVFINCNTSIYRASSLSNCRHTSYVEE

SEQ ID NO: 1893 - protein, 42 aa, Artificial Sequence
  chemically synthesized
SQVSPFKIPIEELEDRVFINCNTSIYRASSLSNCRHTSSIEE

SEQ ID NO: 1894 - protein, 42 aa, Artificial Sequence
  chemically synthesized
SQVSPFKIPIEELEDRVFINCNTSIYRASSLSNCRHTSSLEE

SEQ ID NO: 1895 - protein, 42 aa, Artificial Sequence
  chemically synthesized
SQVSPFKIPIEELEDRVFINCNTSIYRASSLSNCRHTSSFEE

SEQ ID NO: 1896 - protein, 42 aa, Artificial Sequence
  chemically synthesized
SQVSPFKIPIEELEDRVFINCNTSIYRASSLSNCRHTSSHEE

SEQ ID NO: 1897 - protein, 42 aa, Artificial Sequence
  chemically synthesized
SQVSPFKIPIEELEDRVFINCNTSIYRASSLSNCRHTSSMEE

SEQ ID NO: 1898 - protein, 42 aa, Artificial Sequence
  chemically synthesized
SQVSPFKIPIEELEDRVFINCNTSIYRASSLSNCRHTSSVDE

SEQ ID NO: 1899 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFINCNTSIYRASSLSNCRHTSSVXE

SEQ ID NO: 1900 - protein, 42 aa, Artificial Sequence
  chemically synthesized
SQVSPFKIPIEELEDRVFINCNTSIYRASSLSNCRHTSSVED

SEQ ID NO: 1901 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFINCNTSIYRASSLSNCRHTSSVEX

SEQ ID NO: 1902 - protein, 42 aa, Artificial Sequence
  chemically synthesized
SQVSAFKIPIEELEDRVFINCNTSIYRASSLSNCRHTSSVEE

SEQ ID NO: 1903 - protein, 42 aa, Artificial Sequence
  chemically synthesized
SQVSGFKIPIEELEDRVFINCNTSIYRASSLSNCRHTSSVEE

SEQ ID NO: 1904 - protein, 42 aa, Artificial Sequence
  chemically synthesized
SQVSPFKIAIEELEDRVFINCNTSIYRASSLSNCRHTSSVEE

SEQ ID NO: 1905 - protein, 42 aa, Artificial Sequence
  chemically synthesized
SQVSPFKIGIEELEDRVFINCNTSIYRASSLSNCRHTSSVEE

SEQ ID NO: 1906 - protein, 42 aa, Artificial Sequence; identical to SEQ ID NO: 61
  chemically synthesized

SEQ ID NO: 1907 - protein, 42 aa, Artificial Sequence; identical to SEQ ID NO: 180
  chemically synthesized

SEQ ID NO: 1908 - protein, 42 aa, Artificial Sequence
  chemically synthesized
YQVSPFKIPIEELEDRVFVQCNTSIYRASSLSNCRHTSSVEE

SEQ ID NO: 1909 - protein, 42 aa, Artificial Sequence; identical to SEQ ID NO: 300
  chemically synthesized

SEQ ID NO: 1910 - protein, 42 aa, Artificial Sequence; identical to SEQ ID NO: 418
  chemically synthesized

SEQ ID NO: 1911 - protein, 42 aa, Artificial Sequence
  chemically synthesized
SQISPFKIPIEELEDRVFVQCNTSIYRASSLSNCRHTSSVEE

SEQ ID NO: 1912 - protein, 42 aa, Artificial Sequence
  chemically synthesized
SQPSPFKIPIEELEDRVFVQCNTSIYRASSLSNCRHTSSVEE

SEQ ID NO: 1913 - protein, 42 aa, Artificial Sequence
  chemically synthesized
SQFSPFKIPIEELEDRVFVQCNTSIYRASSLSNCRHTSSVEE

SEQ ID NO: 1914 - protein, 42 aa, Artificial Sequence; identical to SEQ ID NO: 537
  chemically synthesized

SEQ ID NO: 1915 - protein, 42 aa, Artificial Sequence
  chemically synthesized
SQVYPFKIPIEELEDRVFVQCNTSIYRASSLSNCRHTSSVEE

SEQ ID NO: 1916 - protein, 42 aa, Artificial Sequence
  chemically synthesized
SQVSPWKIPIEELEDRVFVQCNTSIYRASSLSNCRHTSSVEE

SEQ ID NO: 1917 - protein, 42 aa, Artificial Sequence
  chemically synthesized
SQVSPYKIPIEELEDRVFVQCNTSIYRASSLSNCRHTSSVEE

SEQ ID NO: 1918 - protein, 42 aa, Artificial Sequence
  chemically synthesized
SQVSPHKIPIEELEDRVFVQCNTSIYRASSLSNCRHTSSVEE

SEQ ID NO: 1919 - protein, 42 aa, Artificial Sequence
  chemically synthesized
SQVSPFRIPIEELEDRVFVQCNTSIYRASSLSNCRHTSSVEE

SEQ ID NO: 1920 - protein, 42 aa, Artificial Sequence
  chemically synthesized
SQVSPFHIPIEELEDRVFVQCNTSIYRASSLSNCRHTSSVEE

SEQ ID NO: 1921 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVQCNTSIYRASSLSNCRHTSSVEE

SEQ ID NO: 1922 - protein, 42 aa, Artificial Sequence; identical to SEQ ID NO: 776
  chemically synthesized

SEQ ID NO: 1923 - protein, 42 aa, Artificial Sequence
  chemically synthesized
SQVSPFKHPIEELEDRVFVQCNTSIYRASSLSNCRHTSSVEE

SEQ ID NO: 1924 - protein, 42 aa, Artificial Sequence
  chemically synthesized
SQVSPFKVPIEELEDRVFVQCNTSIYRASSLSNCRHTSSVEE

SEQ ID NO: 1925 - protein, 42 aa, Artificial Sequence
  chemically synthesized
SQVSPFKFPIEELEDRVFVQCNTSIYRASSLSNCRHTSSVEE

SEQ ID NO: 1926 - protein, 42 aa, Artificial Sequence
  chemically synthesized
SQVSPFKMPIEELEDRVFVQCNTSIYRASSLSNCRHTSSVEE

SEQ ID NO: 1927 - protein, 42 aa, Artificial Sequence; identical to SEQ ID NO: 894
  chemically synthesized

SEQ ID NO: 1928 - protein, 42 aa, Artificial Sequence
  chemically synthesized
SQVSPFKIPHEELEDRVFVQCNTSIYRASSLSNCRHTSSVEE

SEQ ID NO: 1929 - protein, 42 aa, Artificial Sequence
  chemically synthesized
SQVSPFKIPVEELEDRVFVQCNTSIYRASSLSNCRHTSSVEE

SEQ ID NO: 1930 - protein, 42 aa, Artificial Sequence
  chemically synthesized
SQVSPFKIPFEELEDRVFVQCNTSIYRASSLSNCRHTSSVEE

SEQ ID NO: 1931 - protein, 42 aa, Artificial Sequence
  chemically synthesized
SQVSPFKIPMEELEDRVFVQCNTSIYRASSLSNCRHTSSVEE

SEQ ID NO: 1932 - protein, 42 aa, Artificial Sequence; identical to SEQ ID NO: 1014
  chemically synthesized

SEQ ID NO: 1933 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVQCNTSIYRASSLSNCRHTSSVEE

SEQ ID NO: 1934 - protein, 42 aa, Artificial Sequence; identical to SEQ ID NO: 1134
  chemically synthesized

SEQ ID NO: 1935 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVQCNTSIYRASSLSNCRHTSSVEE

SEQ ID NO: 1936 - protein, 42 aa, Artificial Sequence
  chemically synthesized
SQVSPFKIPIEEVEDRVFVQCNTSIYRASSLSNCRHTSSVEE

SEQ ID NO: 1937 - protein, 42 aa, Artificial Sequence; identical to SEQ ID NO: 1251
  chemically synthesized

SEQ ID NO: 1938 - protein, 42 aa, Artificial Sequence
  chemically synthesized
SQVSPFKIPIEEFEDRVFVQCNTSIYRASSLSNCRHTSSVEE

SEQ ID NO: 1939 - protein, 42 aa, Artificial Sequence
  chemically synthesized
SQVSPFKIPIEEHEDRVFVQCNTSIYRASSLSNCRHTSSVEE

SEQ ID NO: 1940 - protein, 42 aa, Artificial Sequence
  chemically synthesized
SQVSPFKIPIEEMEDRVFVQCNTSIYRASSLSNCRHTSSVEE

SEQ ID NO: 1941 - protein, 42 aa, Artificial Sequence; identical to SEQ ID NO: 1371
  chemically synthesized

SEQ ID NO: 1942 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVQCNTSIYRASSLSNCRHTSSVEE

SEQ ID NO: 1943 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVQCNTSIYRASSLSNCRHTSSVEE

SEQ ID NO: 1944 - protein, 42 aa, Artificial Sequence
  chemically synthesized
SQVSPFKIPIEELEERVFVQCNTSIYRASSLSNCRHTSSVEE

SEQ ID NO: 1945 - protein, 42 aa, Artificial Sequence; identical to SEQ ID NO: 1490
  chemically synthesized

SEQ ID NO: 1946 - protein, 42 aa, Artificial Sequence
  chemically synthesized
SQVSPFKIPIEELEDHVFVQCNTSIYRASSLSNCRHTSSVEE

SEQ ID NO: 1947 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVQCNTSIYRASSLSNCRHTSSVEE

SEQ ID NO: 1948 - protein, 42 aa, Artificial Sequence; identical to SEQ ID NO: 1607
  chemically synthesized

SEQ ID NO: 1949 - protein, 42 aa, Artificial Sequence
  chemically synthesized
SQVSPFKIPIEELEDRLFVQCNTSIYRASSLSNCRHTSSVEE

SEQ ID NO: 1950 - protein, 42 aa, Artificial Sequence
  chemically synthesized
SQVSPFKIPIEELEDRFFVQCNTSIYRASSLSNCRHTSSVEE

SEQ ID NO: 1951 - protein, 42 aa, Artificial Sequence
  chemically synthesized
SQVSPFKIPIEELEDRHFVQCNTSIYRASSLSNCRHTSSVEE

SEQ ID NO: 1952 - protein, 42 aa, Artificial Sequence
  chemically synthesized
SQVSPFKIPIEELEDRMFVQCNTSIYRASSLSNCRHTSSVEE

SEQ ID NO: 1953 - protein, 42 aa, Artificial Sequence; identical to SEQ ID NO: 1724
  chemically synthesized

SEQ ID NO: 1954 - protein, 42 aa, Artificial Sequence
  chemically synthesized
SQVSPFKIPIEELEDRVLVQCNTSIYRASSLSNCRHTSSVEE

SEQ ID NO: 1955 - protein, 42 aa, Artificial Sequence
  chemically synthesized
SQVSPFKIPIEELEDRVVVQCNTSIYRASSLSNCRHTSSVEE

SEQ ID NO: 1956 - protein, 42 aa, Artificial Sequence
  chemically synthesized
SQVSPFKIPIEELEDRVHVQCNTSIYRASSLSNCRHTSSVEE

SEQ ID NO: 1957 - protein, 42 aa, Artificial Sequence
  chemically synthesized
SQVSPFKIPIEELEDRVMVQCNTSIYRASSLSNCRHTSSVEE

SEQ ID NO: 1958 - protein, 42 aa, Artificial Sequence; identical to SEQ ID NO: 1841
  chemically synthesized

SEQ ID NO: 1959 - protein, 42 aa, Artificial Sequence
  chemically synthesized
SQVSPFKIPIEELEDRVFLQCNTSIYRASSLSNCRHTSSVEE

SEQ ID NO: 1960 - protein, 42 aa, Artificial Sequence
  chemically synthesized
SQVSPFKIPIEELEDRVFFQCNTSIYRASSLSNCRHTSSVEE

SEQ ID NO: 1961 - protein, 42 aa, Artificial Sequence
  chemically synthesized
SQVSPFKIPIEELEDRVFHQCNTSIYRASSLSNCRHTSSVEE

SEQ ID NO: 1962 - protein, 42 aa, Artificial Sequence
  chemically synthesized
SQVSPFKIPIEELEDRVFMQCNTSIYRASSLSNCRHTSSVEE

SEQ ID NO: 1963 - protein, 42 aa, Artificial Sequence
  chemically synthesized
SQVSPFKIPIEELEDRVFVQSNTSIYRASSLSNCRHTSSVEE

SEQ ID NO: 1964 - protein, 42 aa, Artificial Sequence
  chemically synthesized
SQVSPFKIPIEELEDRVFVQGNTSIYRASSLSNCRHTSSVEE

SEQ ID NO: 1965 - protein, 42 aa, Artificial Sequence
  chemically synthesized
SQVSPFKIPIEELEDRVFVQANTSIYRASSLSNCRHTSSVEE

SEQ ID NO: 1966 - protein, 42 aa, Artificial Sequence
  chemically synthesized
SQVSPFKIPIEELEDRVFVQCQTSIYRASSLSNCRHTSSVEE

SEQ ID NO: 1967 - protein, 42 aa, Artificial Sequence
  chemically synthesized
SQVSPFKIPIEELEDRVFVQCNSSIYRASSLSNCRHTSSVEE

SEQ ID NO: 1968 - protein, 42 aa, Artificial Sequence
  chemically synthesized
SQVSPFKIPIEELEDRVFVQCNYSIYRASSLSNCRHTSSVEE

SEQ ID NO: 1969 - protein, 42 aa, Artificial Sequence
  chemically synthesized
SQVSPFKIPIEELEDRVFVQCNTTIYRASSLSNCRHTSSVEE

SEQ ID NO: 1970 - protein, 42 aa, Artificial Sequence
  chemically synthesized
SQVSPFKIPIEELEDRVFVQCNTYIYRASSLSNCRHTSSVEE

SEQ ID NO: 1971 - protein, 42 aa, Artificial Sequence
  chemically synthesized
SQVSPFKIPIEELEDRVFVQCNTSVYRASSLSNCRHTSSVEE

SEQ ID NO: 1972 - protein, 42 aa, Artificial Sequence
  chemically synthesized
SQVSPFKIPIEELEDRVFVQCNTSLYRASSLSNCRHTSSVEE

SEQ ID NO: 1973 - protein, 42 aa, Artificial Sequence
  chemically synthesized
SQVSPFKIPIEELEDRVFVQCNTSHYRASSLSNCRHTSSVEE

SEQ ID NO: 1974 - protein, 42 aa, Artificial Sequence
  chemically synthesized
SQVSPFKIPIEELEDRVFVQCNTSFYRASSLSNCRHTSSVEE

SEQ ID NO: 1975 - protein, 42 aa, Artificial Sequence
  chemically synthesized
SQVSPFKIPIEELEDRVFVQCNTSMYRASSLSNCRHTSSVEE

SEQ ID NO: 1976 - protein, 42 aa, Artificial Sequence
  chemically synthesized
SQVSPFKIPIEELEDRVFVQCNTSIWRASSLSNCRHTSSVEE

SEQ ID NO: 1977 - protein, 42 aa, Artificial Sequence
  chemically synthesized
SQVSPFKIPIEELEDRVFVQCNTSIFRASSLSNCRHTSSVEE

SEQ ID NO: 1978 - protein, 42 aa, Artificial Sequence
  chemically synthesized
SQVSPFKIPIEELEDRVFVQCNTSISRASSLSNCRHTSSVEE

SEQ ID NO: 1979 - protein, 42 aa, Artificial Sequence
  chemically synthesized
SQVSPFKIPIEELEDRVFVQCNTSITRASSLSNCRHTSSVEE

SEQ ID NO: 1980 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVQCNTSIYXASSLSNCRHTSSVEE

SEQ ID NO: 1981 - protein, 42 aa, Artificial Sequence
  chemically synthesized
SQVSPFKIPIEELEDRVFVQCNTSIYHASSLSNCRHTSSVEE

SEQ ID NO: 1982 - protein, 42 aa, Artificial Sequence
  chemically synthesized
SQVSPFKIPIEELEDRVFVQCNTSIYKASSLSNCRHTSSVEE

SEQ ID NO: 1983 - protein, 42 aa, Artificial Sequence
  chemically synthesized
SQVSPFKIPIEELEDRVFVQCNTSIYRGSSLSNCRHTSSVEE

SEQ ID NO: 1984 - protein, 42 aa, Artificial Sequence
  chemically synthesized
SQVSPFKIPIEELEDRVFVQCNTSIYRATSLSNCRHTSSVEE

SEQ ID NO: 1985 - protein, 42 aa, Artificial Sequence
  chemically synthesized
SQVSPFKIPIEELEDRVFVQCNTSIYRAYSLSNCRHTSSVEE

SEQ ID NO: 1986 - protein, 42 aa, Artificial Sequence
  chemically synthesized
SQVSPFKIPIEELEDRVFVQCNTSIYRASTLSNCRHTSSVEE

SEQ ID NO: 1987 - protein, 42 aa, Artificial Sequence
  chemically synthesized
SQVSPFKIPIEELEDRVFVQCNTSIYRASYLSNCRHTSSVEE

SEQ ID NO: 1988 - protein, 42 aa, Artificial Sequence
  chemically synthesized
SQVSPFKIPIEELEDRVFVQCNTSIYRASSISNCRHTSSVEE

SEQ ID NO: 1989 - protein, 42 aa, Artificial Sequence
  chemically synthesized
SQVSPFKIPIEELEDRVFVQCNTSIYRASSVSNCRHTSSVEE

SEQ ID NO: 1990 - protein, 42 aa, Artificial Sequence
  chemically synthesized
SQVSPFKIPIEELEDRVFVQCNTSIYRASSFSNCRHTSSVEE

SEQ ID NO: 1991 - protein, 42 aa, Artificial Sequence
  chemically synthesized
SQVSPFKIPIEELEDRVFVQCNTSIYRASSMSNCRHTSSVEE

SEQ ID NO: 1992 - protein, 42 aa, Artificial Sequence
  chemically synthesized
SQVSPFKIPIEELEDRVFVQCNTSIYRASSHSNCRHTSSVEE

SEQ ID NO: 1993 - protein, 42 aa, Artificial Sequence
  chemically synthesized
SQVSPFKIPIEELEDRVFVQCNTSIYRASSLTNCRHTSSVEE

SEQ ID NO: 1994 - protein, 42 aa, Artificial Sequence
  chemically synthesized
SQVSPFKIPIEELEDRVFVQCNTSIYRASSLYNCRHTSSVEE

SEQ ID NO: 1995 - protein, 42 aa, Artificial Sequence
  chemically synthesized
SQVSPFKIPIEELEDRVFVQCNTSIYRASSLSQCRHTSSVEE

SEQ ID NO: 1996 - protein, 42 aa, Artificial Sequence
  chemically synthesized
SQVSPFKIPIEELEDRVFVQCNTSIYRASSLSNSRHTSSVEE

SEQ ID NO: 1997 - protein, 42 aa, Artificial Sequence
  chemically synthesized
SQVSPFKIPIEELEDRVFVQCNTSIYRASSLSNGRHTSSVEE

SEQ ID NO: 1998 - protein, 42 aa, Artificial Sequence
  chemically synthesized
SQVSPFKIPIEELEDRVFVQCNTSIYRASSLSNARHTSSVEE

SEQ ID NO: 1999 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVQCNTSIYRASSLSNCXHTSSVEE

SEQ ID NO: 2000 - protein, 42 aa, Artificial Sequence
  chemically synthesized
SQVSPFKIPIEELEDRVFVQCNTSIYRASSLSNCHHTSSVEE

SEQ ID NO: 2001 - protein, 42 aa, Artificial Sequence
  chemically synthesized
SQVSPFKIPIEELEDRVFVQCNTSIYRASSLSNCKHTSSVEE

SEQ ID NO: 2002 - protein, 42 aa, Artificial Sequence
  chemically synthesized
SQVSPFKIPIEELEDRVFVQCNTSIYRASSLSNCRGTSSVEE

SEQ ID NO: 2003 - protein, 42 aa, Artificial Sequence
  chemically synthesized
SQVSPFKIPIEELEDRVFVQCNTSIYRASSLSNCRATSSVEE

SEQ ID NO: 2004 - protein, 42 aa, Artificial Sequence
  chemically synthesized
SQVSPFKIPIEELEDRVFVQCNTSIYRASSLSNCRITSSVEE

SEQ ID NO: 2005 - protein, 42 aa, Artificial Sequence
  chemically synthesized
SQVSPFKIPIEELEDRVFVQCNTSIYRASSLSNCRLTSSVEE

SEQ ID NO: 2006 - protein, 42 aa, Artificial Sequence
  chemically synthesized
SQVSPFKIPIEELEDRVFVQCNTSIYRASSLSNCRMTSSVEE

SEQ ID NO: 2007 - protein, 42 aa, Artificial Sequence
  chemically synthesized
SQVSPFKIPIEELEDRVFVQCNTSIYRASSLSNCRVTSSVEE

SEQ ID NO: 2008 - protein, 42 aa, Artificial Sequence
  chemically synthesized
SQVSPFKIPIEELEDRVFVQCNTSIYRASSLSNCRHSSSVEE

SEQ ID NO: 2009 - protein, 42 aa, Artificial Sequence
  chemically synthesized
SQVSPFKIPIEELEDRVFVQCNTSIYRASSLSNCRHYSSVEE

SEQ ID NO: 2010 - protein, 42 aa, Artificial Sequence
  chemically synthesized
SQVSPFKIPIEELEDRVFVQCNTSIYRASSLSNCRHTTSVEE

SEQ ID NO: 2011 - protein, 42 aa, Artificial Sequence
  chemically synthesized
SQVSPFKIPIEELEDRVFVQCNTSIYRASSLSNCRHTYSVEE

SEQ ID NO: 2012 - protein, 42 aa, Artificial Sequence
  chemically synthesized
SQVSPFKIPIEELEDRVFVQCNTSIYRASSLSNCRHTSTVEE

SEQ ID NO: 2013 - protein, 42 aa, Artificial Sequence
  chemically synthesized
SQVSPFKIPIEELEDRVFVQCNTSIYRASSLSNCRHTSYVEE

SEQ ID NO: 2014 - protein, 42 aa, Artificial Sequence
  chemically synthesized
SQVSPFKIPIEELEDRVFVQCNTSIYRASSLSNCRHTSSIEE

SEQ ID NO: 2015 - protein, 42 aa, Artificial Sequence
  chemically synthesized
SQVSPFKIPIEELEDRVFVQCNTSIYRASSLSNCRHTSSLEE

SEQ ID NO: 2016 - protein, 42 aa, Artificial Sequence
  chemically synthesized
SQVSPFKIPIEELEDRVFVQCNTSIYRASSLSNCRHTSSFEE

SEQ ID NO: 2017 - protein, 42 aa, Artificial Sequence
  chemically synthesized
SQVSPFKIPIEELEDRVFVQCNTSIYRASSLSNCRHTSSHEE

SEQ ID NO: 2018 - protein, 42 aa, Artificial Sequence
  chemically synthesized
SQVSPFKIPIEELEDRVFVQCNTSIYRASSLSNCRHTSSMEE

SEQ ID NO: 2019 - protein, 42 aa, Artificial Sequence
  chemically synthesized
SQVSPFKIPIEELEDRVFVQCNTSIYRASSLSNCRHTSSVDE

SEQ ID NO: 2020 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVQCNTSIYRASSLSNCRHTSSVXE

SEQ ID NO: 2021 - protein, 42 aa, Artificial Sequence
  chemically synthesized
SQVSPFKIPIEELEDRVFVQCNTSIYRASSLSNCRHTSSVED

SEQ ID NO: 2022 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVQCNTSIYRASSLSNCRHTSSVEX

SEQ ID NO: 2023 - protein, 42 aa, Artificial Sequence
  chemically synthesized
SQVSAFKIPIEELEDRVFVQCNTSIYRASSLSNCRHTSSVEE

SEQ ID NO: 2024 - protein, 42 aa, Artificial Sequence
  chemically synthesized
SQVSGFKIPIEELEDRVFVQCNTSIYRASSLSNCRHTSSVEE

SEQ ID NO: 2025 - protein, 42 aa, Artificial Sequence
  chemically synthesized
SQVSPFKIAIEELEDRVFVQCNTSIYRASSLSNCRHTSSVEE

SEQ ID NO: 2026 - protein, 42 aa, Artificial Sequence
  chemically synthesized
SQVSPFKIGIEELEDRVFVQCNTSIYRASSLSNCRHTSSVEE

SEQ ID NO: 2027 - protein, 42 aa, Artificial Sequence
  chemically synthesized
SQVSPFKIPIEELEDRVFVNSNTSIYRASSLSNSRHTSSVEE

SEQ ID NO: 2028 - protein, 42 aa, Artificial Sequence
  chemically synthesized
TQVSPFKIPIEELEDRVFVNSNTSIYRASSLSNSRHTSSVEE

SEQ ID NO: 2029 - protein, 42 aa, Artificial Sequence
  chemically synthesized
YQVSPFKIPIEELEDRVFVNSNTSIYRASSLSNSRHTSSVEE

SEQ ID NO: 2030 - protein, 42 aa, Artificial Sequence
  chemically synthesized
SNVSPFKIPIEELEDRVFVNSNTSIYRASSLSNSRHTSSVEE

SEQ ID NO: 2031 - protein, 42 aa, Artificial Sequence
  chemically synthesized
SQLSPFKIPIEELEDRVFVNSNTSIYRASSLSNSRHTSSVEE

SEQ ID NO: 2032 - protein, 42 aa, Artificial Sequence
  chemically synthesized
SQISPFKIPIEELEDRVFVNSNTSIYRASSLSNSRHTSSVEE

SEQ ID NO: 2033 - protein, 42 aa, Artificial Sequence
  chemically synthesized
SQPSPFKIPIEELEDRVFVNSNTSIYRASSLSNSRHTSSVEE

SEQ ID NO: 2034 - protein, 42 aa, Artificial Sequence
  chemically synthesized
SQFSPFKIPIEELEDRVFVNSNTSIYRASSLSNSRHTSSVEE

SEQ ID NO: 2035 - protein, 42 aa, Artificial Sequence
  chemically synthesized
SQVTPFKIPIEELEDRVFVNSNTSIYRASSLSNSRHTSSVEE

SEQ ID NO: 2036 - protein, 42 aa, Artificial Sequence
  chemically synthesized
SQVYPFKIPIEELEDRVFVNSNTSIYRASSLSNSRHTSSVEE

SEQ ID NO: 2037 - protein, 42 aa, Artificial Sequence
  chemically synthesized
SQVSPWKIPIEELEDRVFVNSNTSIYRASSLSNSRHTSSVEE

SEQ ID NO: 2038 - protein, 42 aa, Artificial Sequence
  chemically synthesized
SQVSPYKIPIEELEDRVFVNSNTSIYRASSLSNSRHTSSVEE

SEQ ID NO: 2039 - protein, 42 aa, Artificial Sequence
  chemically synthesized
SQVSPHKIPIEELEDRVFVNSNTSIYRASSLSNSRHTSSVEE

SEQ ID NO: 2040 - protein, 42 aa, Artificial Sequence
  chemically synthesized
SQVSPFRIPIEELEDRVFVNSNTSIYRASSLSNSRHTSSVEE

SEQ ID NO: 2041 - protein, 42 aa, Artificial Sequence
  chemically synthesized
SQVSPFHIPIEELEDRVFVNSNTSIYRASSLSNSRHTSSVEE

SEQ ID NO: 2042 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNSNTSIYRASSLSNSRHTSSVEE

SEQ ID NO: 2043 - protein, 42 aa, Artificial Sequence
  chemically synthesized
SQVSPFKLPIEELEDRVFVNSNTSIYRASSLSNSRHTSSVEE

SEQ ID NO: 2044 - protein, 42 aa, Artificial Sequence
  chemically synthesized
SQVSPFKHPIEELEDRVFVNSNTSIYRASSLSNSRHTSSVEE

SEQ ID NO: 2045 - protein, 42 aa, Artificial Sequence
  chemically synthesized
SQVSPFKVPIEELEDRVFVNSNTSIYRASSLSNSRHTSSVEE

SEQ ID NO: 2046 - protein, 42 aa, Artificial Sequence
  chemically synthesized
SQVSPFKFPIEELEDRVFVNSNTSIYRASSLSNSRHTSSVEE

SEQ ID NO: 2047 - protein, 42 aa, Artificial Sequence
  chemically synthesized
SQVSPFKMPIEELEDRVFVNSNTSIYRASSLSNSRHTSSVEE

SEQ ID NO: 2048 - protein, 42 aa, Artificial Sequence
  chemically synthesized
SQVSPFKIPLEELEDRVFVNSNTSIYRASSLSNSRHTSSVEE

SEQ ID NO: 2049 - protein, 42 aa, Artificial Sequence
  chemically synthesized
SQVSPFKIPHEELEDRVFVNSNTSIYRASSLSNSRHTSSVEE

SEQ ID NO: 2050 - protein, 42 aa, Artificial Sequence
  chemically synthesized
SQVSPFKIPVEELEDRVFVNSNTSIYRASSLSNSRHTSSVEE

SEQ ID NO: 2051 - protein, 42 aa, Artificial Sequence
  chemically synthesized
SQVSPFKIPFEELEDRVFVNSNTSIYRASSLSNSRHTSSVEE

SEQ ID NO: 2052 - protein, 42 aa, Artificial Sequence
  chemically synthesized
SQVSPFKIPMEELEDRVFVNSNTSIYRASSLSNSRHTSSVEE

SEQ ID NO: 2053 - protein, 42 aa, Artificial Sequence
  chemically synthesized
SQVSPFKIPIDELEDRVFVNSNTSIYRASSLSNSRHTSSVEE

SEQ ID NO: 2054 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNSNTSIYRASSLSNSRHTSSVEE

SEQ ID NO: 2055 - protein, 42 aa, Artificial Sequence
  chemically synthesized
SQVSPFKIPIEDLEDRVFVNSNTSIYRASSLSNSRHTSSVEE

SEQ ID NO: 2056 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNSNTSIYRASSLSNSRHTSSVEE

SEQ ID NO: 2057 - protein, 42 aa, Artificial Sequence
  chemically synthesized
SQVSPFKIPIEEVEDRVFVNSNTSIYRASSLSNSRHTSSVEE

SEQ ID NO: 2058 - protein, 42 aa, Artificial Sequence
  chemically synthesized
SQVSPFKIPIEEIEDRVFVNSNTSIYRASSLSNSRHTSSVEE

SEQ ID NO: 2059 - protein, 42 aa, Artificial Sequence
  chemically synthesized
SQVSPFKIPIEEFEDRVFVNSNTSIYRASSLSNSRHTSSVEE

SEQ ID NO: 2060 - protein, 42 aa, Artificial Sequence
  chemically synthesized
SQVSPFKIPIEEHEDRVFVNSNTSIYRASSLSNSRHTSSVEE

SEQ ID NO: 2061 - protein, 42 aa, Artificial Sequence
  chemically synthesized
SQVSPFKIPIEEMEDRVFVNSNTSIYRASSLSNSRHTSSVEE

SEQ ID NO: 2062 - protein, 42 aa, Artificial Sequence
  chemically synthesized
SQVSPFKIPIEELDDRVFVNSNTSIYRASSLSNSRHTSSVEE

SEQ ID NO: 2063 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNSNTSIYRASSLSNSRHTSSVEE

SEQ ID NO: 2064 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNSNTSIYRASSLSNSRHTSSVEE

SEQ ID NO: 2065 - protein, 42 aa, Artificial Sequence
  chemically synthesized
SQVSPFKIPIEELEERVFVNSNTSIYRASSLSNSRHTSSVEE

SEQ ID NO: 2066 - protein, 42 aa, Artificial Sequence
  chemically synthesized
SQVSPFKIPIEELEDKVFVNSNTSIYRASSLSNSRHTSSVEE

SEQ ID NO: 2067 - protein, 42 aa, Artificial Sequence
  chemically synthesized
SQVSPFKIPIEELEDHVFVNSNTSIYRASSLSNSRHTSSVEE

SEQ ID NO: 2068 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNSNTSIYRASSLSNSRHTSSVEE

SEQ ID NO: 2069 - protein, 42 aa, Artificial Sequence
  chemically synthesized
SQVSPFKIPIEELEDRIFVNSNTSIYRASSLSNSRHTSSVEE

SEQ ID NO: 2070 - protein, 42 aa, Artificial Sequence
  chemically synthesized
SQVSPFKIPIEELEDRLFVNSNTSIYRASSLSNSRHTSSVEE

SEQ ID NO: 2071 - protein, 42 aa, Artificial Sequence
  chemically synthesized
SQVSPFKIPIEELEDRFFVNSNTSIYRASSLSNSRHTSSVEE

SEQ ID NO: 2072 - protein, 42 aa, Artificial Sequence
  chemically synthesized
SQVSPFKIPIEELEDRHFVNSNTSIYRASSLSNSRHTSSVEE

SEQ ID NO: 2073 - protein, 42 aa, Artificial Sequence
  chemically synthesized
SQVSPFKIPIEELEDRMFVNSNTSIYRASSLSNSRHTSSVEE

SEQ ID NO: 2074 - protein, 42 aa, Artificial Sequence
  chemically synthesized
SQVSPFKIPIEELEDRVIVNSNTSIYRASSLSNSRHTSSVEE

SEQ ID NO: 2075 - protein, 42 aa, Artificial Sequence
  chemically synthesized
SQVSPFKIPIEELEDRVLVNSNTSIYRASSLSNSRHTSSVEE

SEQ ID NO: 2076 - protein, 42 aa, Artificial Sequence
  chemically synthesized
SQVSPFKIPIEELEDRVVVNSNTSIYRASSLSNSRHTSSVEE

SEQ ID NO: 2077 - protein, 42 aa, Artificial Sequence
  chemically synthesized
SQVSPFKIPIEELEDRVHVNSNTSIYRASSLSNSRHTSSVEE

SEQ ID NO: 2078 - protein, 42 aa, Artificial Sequence
  chemically synthesized
SQVSPFKIPIEELEDRVMVNSNTSIYRASSLSNSRHTSSVEE

SEQ ID NO: 2079 - protein, 42 aa, Artificial Sequence
  chemically synthesized
SQVSPFKIPIEELEDRVFINSNTSIYRASSLSNSRHTSSVEE

SEQ ID NO: 2080 - protein, 42 aa, Artificial Sequence
  chemically synthesized
SQVSPFKIPIEELEDRVFLNSNTSIYRASSLSNSRHTSSVEE

SEQ ID NO: 2081 - protein, 42 aa, Artificial Sequence
  chemically synthesized
SQVSPFKIPIEELEDRVFFNSNTSIYRASSLSNSRHTSSVEE

SEQ ID NO: 2082 - protein, 42 aa, Artificial Sequence
  chemically synthesized
SQVSPFKIPIEELEDRVFHNSNTSIYRASSLSNSRHTSSVEE

SEQ ID NO: 2083 - protein, 42 aa, Artificial Sequence
  chemically synthesized
SQVSPFKIPIEELEDRVFMNSNTSIYRASSLSNSRHTSSVEE

SEQ ID NO: 2084 - protein, 42 aa, Artificial Sequence
  chemically synthesized
SQVSPFKIPIEELEDRVFVQSNTSIYRASSLSNSRHTSSVEE

SEQ ID NO: 2085 - protein, 42 aa, Artificial Sequence
  chemically synthesized
SQVSPFKIPIEELEDRVFVNGNTSIYRASSLSNSRHTSSVEE

SEQ ID NO: 2086 - protein, 42 aa, Artificial Sequence
  chemically synthesized
SQVSPFKIPIEELEDRVFVNANTSIYRASSLSNSRHTSSVEE

SEQ ID NO: 2087 - protein, 42 aa, Artificial Sequence
  chemically synthesized
SQVSPFKIPIEELEDRVFVNSQTSIYRASSLSNSRHTSSVEE

SEQ ID NO: 2088 - protein, 42 aa, Artificial Sequence
  chemically synthesized
SQVSPFKIPIEELEDRVFVNSNSSIYRASSLSNSRHTSSVEE

SEQ ID NO: 2089 - protein, 42 aa, Artificial Sequence
  chemically synthesized
SQVSPFKIPIEELEDRVFVNSNYSIYRASSLSNSRHTSSVEE

SEQ ID NO: 2090 - protein, 42 aa, Artificial Sequence
  chemically synthesized
SQVSPFKIPIEELEDRVFVNSNTTIYRASSLSNSRHTSSVEE

SEQ ID NO: 2091 - protein, 42 aa, Artificial Sequence
  chemically synthesized
SQVSPFKIPIEELEDRVFVNSNTYIYRASSLSNSRHTSSVEE

SEQ ID NO: 2092 - protein, 42 aa, Artificial Sequence
  chemically synthesized
SQVSPFKIPIEELEDRVFVNSNTSVYRASSLSNSRHTSSVEE

SEQ ID NO: 2093 - protein, 42 aa, Artificial Sequence
  chemically synthesized
SQVSPFKIPIEELEDRVFVNSNTSLYRASSLSNSRHTSSVEE

SEQ ID NO: 2094 - protein, 42 aa, Artificial Sequence
  chemically synthesized
SQVSPFKIPIEELEDRVFVNSNTSHYRASSLSNSRHTSSVEE

SEQ ID NO: 2095 - protein, 42 aa, Artificial Sequence
  chemically synthesized
SQVSPFKIPIEELEDRVFVNSNTSFYRASSLSNSRHTSSVEE

SEQ ID NO: 2096 - protein, 42 aa, Artificial Sequence
  chemically synthesized
SQVSPFKIPIEELEDRVFVNSNTSMYRASSLSNSRHTSSVEE

SEQ ID NO: 2097 - protein, 42 aa, Artificial Sequence
  chemically synthesized
SQVSPFKIPIEELEDRVFVNSNTSIWRASSLSNSRHTSSVEE

SEQ ID NO: 2098 - protein, 42 aa, Artificial Sequence
  chemically synthesized
SQVSPFKIPIEELEDRVFVNSNTSIFRASSLSNSRHTSSVEE

SEQ ID NO: 2099 - protein, 42 aa, Artificial Sequence
  chemically synthesized
SQVSPFKIPIEELEDRVFVNSNTSISRASSLSNSRHTSSVEE

SEQ ID NO: 2100 - protein, 42 aa, Artificial Sequence
  chemically synthesized
SQVSPFKIPIEELEDRVFVNSNTSITRASSLSNSRHTSSVEE

SEQ ID NO: 2101 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNSNTSIYXASSLSNSRHTSSVEE

SEQ ID NO: 2102 - protein, 42 aa, Artificial Sequence
  chemically synthesized
SQVSPFKIPIEELEDRVFVNSNTSIYHASSLSNSRHTSSVEE

SEQ ID NO: 2103 - protein, 42 aa, Artificial Sequence
  chemically synthesized
SQVSPFKIPIEELEDRVFVNSNTSIYKASSLSNSRHTSSVEE

SEQ ID NO: 2104 - protein, 42 aa, Artificial Sequence
  chemically synthesized
SQVSPFKIPIEELEDRVFVNSNTSIYRGSSLSNSRHTSSVEE

SEQ ID NO: 2105 - protein, 42 aa, Artificial Sequence
  chemically synthesized
SQVSPFKIPIEELEDRVFVNSNTSIYRATSLSNSRHTSSVEE

SEQ ID NO: 2106 - protein, 42 aa, Artificial Sequence
  chemically synthesized
SQVSPFKIPIEELEDRVFVNSNTSIYRAYSLSNSRHTSSVEE

SEQ ID NO: 2107 - protein, 42 aa, Artificial Sequence
  chemically synthesized
SQVSPFKIPIEELEDRVFVNSNTSIYRASTLSNSRHTSSVEE

SEQ ID NO: 2108 - protein, 42 aa, Artificial Sequence
  chemically synthesized
SQVSPFKIPIEELEDRVFVNSNTSIYRASYLSNSRHTSSVEE

SEQ ID NO: 2109 - protein, 42 aa, Artificial Sequence
  chemically synthesized
SQVSPFKIPIEELEDRVFVNSNTSIYRASSISNSRHTSSVEE

SEQ ID NO: 2110 - protein, 42 aa, Artificial Sequence
  chemically synthesized
SQVSPFKIPIEELEDRVFVNSNTSIYRASSVSNSRHTSSVEE

SEQ ID NO: 2111 - protein, 42 aa, Artificial Sequence
  chemically synthesized
SQVSPFKIPIEELEDRVFVNSNTSIYRASSFSNSRHTSSVEE

SEQ ID NO: 2112 - protein, 42 aa, Artificial Sequence
  chemically synthesized
SQVSPFKIPIEELEDRVFVNSNTSIYRASSMSNSRHTSSVEE

SEQ ID NO: 2113 - protein, 42 aa, Artificial Sequence
  chemically synthesized
SQVSPFKIPIEELEDRVFVNSNTSIYRASSHSNSRHTSSVEE

SEQ ID NO: 2114 - protein, 42 aa, Artificial Sequence
  chemically synthesized
SQVSPFKIPIEELEDRVFVNSNTSIYRASSLTNSRHTSSVEE

SEQ ID NO: 2115 - protein, 42 aa, Artificial Sequence
  chemically synthesized
SQVSPFKIPIEELEDRVFVNSNTSIYRASSLYNSRHTSSVEE

SEQ ID NO: 2116 - protein, 42 aa, Artificial Sequence
  chemically synthesized
SQVSPFKIPIEELEDRVFVNSNTSIYRASSLSQSRHTSSVEE

SEQ ID NO: 2117 - protein, 42 aa, Artificial Sequence
  chemically synthesized
SQVSPFKIPIEELEDRVFVNSNTSIYRASSLSNGRHTSSVEE

SEQ ID NO: 2118 - protein, 42 aa, Artificial Sequence
  chemically synthesized
SQVSPFKIPIEELEDRVFVNSNTSIYRASSLSNARHTSSVEE

SEQ ID NO: 2119 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNSNTSIYRASSLSNSXHTSSVEE

SEQ ID NO: 2120 - protein, 42 aa, Artificial Sequence
  chemically synthesized
SQVSPFKIPIEELEDRVFVNSNTSIYRASSLSNSHHTSSVEE

SEQ ID NO: 2121 - protein, 42 aa, Artificial Sequence
  chemically synthesized
SQVSPFKIPIEELEDRVFVNSNTSIYRASSLSNSKHTSSVEE

SEQ ID NO: 2122 - protein, 42 aa, Artificial Sequence
  chemically synthesized
SQVSPFKIPIEELEDRVFVNSNTSIYRASSLSNSRGTSSVEE

SEQ ID NO: 2123 - protein, 42 aa, Artificial Sequence
  chemically synthesized
SQVSPFKIPIEELEDRVFVNSNTSIYRASSLSNSRATSSVEE

SEQ ID NO: 2124 - protein, 42 aa, Artificial Sequence
  chemically synthesized
SQVSPFKIPIEELEDRVFVNSNTSIYRASSLSNSRITSSVEE

SEQ ID NO: 2125 - protein, 42 aa, Artificial Sequence
  chemically synthesized
SQVSPFKIPIEELEDRVFVNSNTSIYRASSLSNSRLTSSVEE

SEQ ID NO: 2126 - protein, 42 aa, Artificial Sequence
  chemically synthesized
SQVSPFKIPIEELEDRVFVNSNTSIYRASSLSNSRMTSSVEE

SEQ ID NO: 2127 - protein, 42 aa, Artificial Sequence
  chemically synthesized
SQVSPFKIPIEELEDRVFVNSNTSIYRASSLSNSRVTSSVEE

SEQ ID NO: 2128 - protein, 42 aa, Artificial Sequence
  chemically synthesized
SQVSPFKIPIEELEDRVFVNSNTSIYRASSLSNSRHSSSVEE

SEQ ID NO: 2129 - protein, 42 aa, Artificial Sequence
  chemically synthesized
SQVSPFKIPIEELEDRVFVNSNTSIYRASSLSNSRHYSSVEE

SEQ ID NO: 2130 - protein, 42 aa, Artificial Sequence
  chemically synthesized
SQVSPFKIPIEELEDRVFVNSNTSIYRASSLSNSRHTTSVEE

SEQ ID NO: 2131 - protein, 42 aa, Artificial Sequence
  chemically synthesized
SQVSPFKIPIEELEDRVFVNSNTSIYRASSLSNSRHTYSVEE

SEQ ID NO: 2132 - protein, 42 aa, Artificial Sequence
  chemically synthesized
SQVSPFKIPIEELEDRVFVNSNTSIYRASSLSNSRHTSTVEE

SEQ ID NO: 2133 - protein, 42 aa, Artificial Sequence
  chemically synthesized
SQVSPFKIPIEELEDRVFVNSNTSIYRASSLSNSRHTSYVEE

SEQ ID NO: 2134 - protein, 42 aa, Artificial Sequence
  chemically synthesized
SQVSPFKIPIEELEDRVFVNSNTSIYRASSLSNSRHTSSIEE

SEQ ID NO: 2135 - protein, 42 aa, Artificial Sequence
  chemically synthesized
SQVSPFKIPIEELEDRVFVNSNTSIYRASSLSNSRHTSSLEE

SEQ ID NO: 2136 - protein, 42 aa, Artificial Sequence
  chemically synthesized
SQVSPFKIPIEELEDRVFVNSNTSIYRASSLSNSRHTSSFEE

SEQ ID NO: 2137 - protein, 42 aa, Artificial Sequence
  chemically synthesized
SQVSPFKIPIEELEDRVFVNSNTSIYRASSLSNSRHTSSHEE

SEQ ID NO: 2138 - protein, 42 aa, Artificial Sequence
  chemically synthesized
SQVSPFKIPIEELEDRVFVNSNTSIYRASSLSNSRHTSSMEE

SEQ ID NO: 2139 - protein, 42 aa, Artificial Sequence
  chemically synthesized
SQVSPFKIPIEELEDRVFVNSNTSIYRASSLSNSRHTSSVDE

SEQ ID NO: 2140 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNSNTSIYRASSLSNSRHTSSVXE

SEQ ID NO: 2141 - protein, 42 aa, Artificial Sequence
  chemically synthesized
SQVSPFKIPIEELEDRVFVNSNTSIYRASSLSNSRHTSSVED

SEQ ID NO: 2142 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNSNTSIYRASSLSNSRHTSSVEX

SEQ ID NO: 2143 - protein, 42 aa, Artificial Sequence
  chemically synthesized
SQVSAFKIPIEELEDRVFVNSNTSIYRASSLSNSRHTSSVEE

SEQ ID NO: 2144 - protein, 42 aa, Artificial Sequence
  chemically synthesized
SQVSGFKIPIEELEDRVFVNSNTSIYRASSLSNSRHTSSVEE

SEQ ID NO: 2145 - protein, 42 aa, Artificial Sequence
  chemically synthesized
SQVSPFKIAIEELEDRVFVNSNTSIYRASSLSNSRHTSSVEE

SEQ ID NO: 2146 - protein, 42 aa, Artificial Sequence
  chemically synthesized
SQVSPFKIGIEELEDRVFVNSNTSIYRASSLSNSRHTSSVEE

SEQ ID NO: 2147 - protein, 42 aa, Artificial Sequence; identical to SEQ ID NO: 65
  chemically synthesized

SEQ ID NO: 2148 - protein, 42 aa, Artificial Sequence; identical to SEQ ID NO: 184
  chemically synthesized

SEQ ID NO: 2149 - protein, 42 aa, Artificial Sequence
  chemically synthesized
YQVSPFKIPIEELEDRVFVNCQTSIYRASSLSNCRHTSSVEE

SEQ ID NO: 2150 - protein, 42 aa, Artificial Sequence; identical to SEQ ID NO: 304
  chemically synthesized

SEQ ID NO: 2151 - protein, 42 aa, Artificial Sequence; identical to SEQ ID NO: 422
  chemically synthesized

SEQ ID NO: 2152 - protein, 42 aa, Artificial Sequence
  chemically synthesized
SQISPFKIPIEELEDRVFVNCQTSIYRASSLSNCRHTSSVEE

SEQ ID NO: 2153 - protein, 42 aa, Artificial Sequence
  chemically synthesized
SQPSPFKIPIEELEDRVFVNCQTSIYRASSLSNCRHTSSVEE

SEQ ID NO: 2154 - protein, 42 aa, Artificial Sequence
  chemically synthesized
SQFSPFKIPIEELEDRVFVNCQTSIYRASSLSNCRHTSSVEE

SEQ ID NO: 2155 - protein, 42 aa, Artificial Sequence; identical to SEQ ID NO: 541
  chemically synthesized

SEQ ID NO: 2156 - protein, 42 aa, Artificial Sequence
  chemically synthesized
SQVYPFKIPIEELEDRVFVNCQTSIYRASSLSNCRHTSSVEE

SEQ ID NO: 2157 - protein, 42 aa, Artificial Sequence
  chemically synthesized
SQVSPWKIPIEELEDRVFVNCQTSIYRASSLSNCRHTSSVEE

SEQ ID NO: 2158 - protein, 42 aa, Artificial Sequence
  chemically synthesized
SQVSPYKIPIEELEDRVFVNCQTSIYRASSLSNCRHTSSVEE

SEQ ID NO: 2159 - protein, 42 aa, Artificial Sequence
  chemically synthesized
SQVSPHKIPIEELEDRVFVNCQTSIYRASSLSNCRHTSSVEE

SEQ ID NO: 2160 - protein, 42 aa, Artificial Sequence
  chemically synthesized
SQVSPFRIPIEELEDRVFVNCQTSIYRASSLSNCRHTSSVEE

SEQ ID NO: 2161 - protein, 42 aa, Artificial Sequence
  chemically synthesized
SQVSPFHIPIEELEDRVFVNCQTSIYRASSLSNCRHTSSVEE

SEQ ID NO: 2162 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCQTSIYRASSLSNCRHTSSVEE

SEQ ID NO: 2163 - protein, 42 aa, Artificial Sequence; identical to SEQ ID NO: 780
  chemically synthesized

SEQ ID NO: 2164 - protein, 42 aa, Artificial Sequence
  chemically synthesized
SQVSPFKHPIEELEDRVFVNCQTSIYRASSLSNCRHTSSVEE

SEQ ID NO: 2165 - protein, 42 aa, Artificial Sequence
  chemically synthesized
SQVSPFKVPIEELEDRVFVNCQTSIYRASSLSNCRHTSSVEE

SEQ ID NO: 2166 - protein, 42 aa, Artificial Sequence
  chemically synthesized
SQVSPFKFPIEELEDRVFVNCQTSIYRASSLSNCRHTSSVEE

SEQ ID NO: 2167 - protein, 42 aa, Artificial Sequence
  chemically synthesized
SQVSPFKMPIEELEDRVFVNCQTSIYRASSLSNCRHTSSVEE

SEQ ID NO: 2168 - protein, 42 aa, Artificial Sequence; identical to SEQ ID NO: 898
  chemically synthesized

SEQ ID NO: 2169 - protein, 42 aa, Artificial Sequence
  chemically synthesized
SQVSPFKIPHEELEDRVFVNCQTSIYRASSLSNCRHTSSVEE

SEQ ID NO: 2170 - protein, 42 aa, Artificial Sequence
  chemically synthesized
SQVSPFKIPVEELEDRVFVNCQTSIYRASSLSNCRHTSSVEE

SEQ ID NO: 2171 - protein, 42 aa, Artificial Sequence
  chemically synthesized
SQVSPFKIPFEELEDRVFVNCQTSIYRASSLSNCRHTSSVEE

SEQ ID NO: 2172 - protein, 42 aa, Artificial Sequence
  chemically synthesized
SQVSPFKIPMEELEDRVFVNCQTSIYRASSLSNCRHTSSVEE

SEQ ID NO: 2173 - protein, 42 aa, Artificial Sequence; identical to SEQ ID NO: 1018
  chemically synthesized

SEQ ID NO: 2174 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCQTSIYRASSLSNCRHTSSVEE

SEQ ID NO: 2175 - protein, 42 aa, Artificial Sequence; identical to SEQ ID NO: 1138
  chemically synthesized

SEQ ID NO: 2176 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCQTSIYRASSLSNCRHTSSVEE

SEQ ID NO: 2177 - protein, 42 aa, Artificial Sequence
  chemically synthesized
SQVSPFKIPIEEVEDRVFVNCQTSIYRASSLSNCRHTSSVEE

SEQ ID NO: 2178 - protein, 42 aa, Artificial Sequence; identical to SEQ ID NO: 1255
  chemically synthesized

SEQ ID NO: 2179 - protein, 42 aa, Artificial Sequence
  chemically synthesized
SQVSPFKIPIEEFEDRVFVNCQTSIYRASSLSNCRHTSSVEE

SEQ ID NO: 2180 - protein, 42 aa, Artificial Sequence
  chemically synthesized
SQVSPFKIPIEEHEDRVFVNCQTSIYRASSLSNCRHTSSVEE

SEQ ID NO: 2181 - protein, 42 aa, Artificial Sequence
  chemically synthesized
SQVSPFKIPIEEMEDRVFVNCQTSIYRASSLSNCRHTSSVEE

SEQ ID NO: 2182 - protein, 42 aa, Artificial Sequence; identical to SEQ ID NO: 1375
  chemically synthesized

SEQ ID NO: 2183 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCQTSIYRASSLSNCRHTSSVEE

SEQ ID NO: 2184 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCQTSIYRASSLSNCRHTSSVEE

SEQ ID NO: 2185 - protein, 42 aa, Artificial Sequence
  chemically synthesized
SQVSPFKIPIEELEERVFVNCQTSIYRASSLSNCRHTSSVEE

SEQ ID NO: 2186 - protein, 42 aa, Artificial Sequence; identical to SEQ ID NO: 1494
  chemically synthesized

SEQ ID NO: 2187 - protein, 42 aa, Artificial Sequence
  chemically synthesized
SQVSPFKIPIEELEDHVFVNCQTSIYRASSLSNCRHTSSVEE

SEQ ID NO: 2188 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCQTSIYRASSLSNCRHTSSVEE

SEQ ID NO: 2189 - protein, 42 aa, Artificial Sequence; identical to SEQ ID NO: 1611
  chemically synthesized

SEQ ID NO: 2190 - protein, 42 aa, Artificial Sequence
  chemically synthesized
SQVSPFKIPIEELEDRLFVNCQTSIYRASSLSNCRHTSSVEE

SEQ ID NO: 2191 - protein, 42 aa, Artificial Sequence
  chemically synthesized
SQVSPFKIPIEELEDRFFVNCQTSIYRASSLSNCRHTSSVEE

SEQ ID NO: 2192 - protein, 42 aa, Artificial Sequence
  chemically synthesized
SQVSPFKIPIEELEDRHFVNCQTSIYRASSLSNCRHTSSVEE

SEQ ID NO: 2193 - protein, 42 aa, Artificial Sequence
  chemically synthesized
SQVSPFKIPIEELEDRMFVNCQTSIYRASSLSNCRHTSSVEE

SEQ ID NO: 2194 - protein, 42 aa, Artificial Sequence; identical to SEQ ID NO: 1728
  chemically synthesized

SEQ ID NO: 2195 - protein, 42 aa, Artificial Sequence
  chemically synthesized
SQVSPFKIPIEELEDRVLVNCQTSIYRASSLSNCRHTSSVEE

SEQ ID NO: 2196 - protein, 42 aa, Artificial Sequence
  chemically synthesized
SQVSPFKIPIEELEDRVVVNCQTSIYRASSLSNCRHTSSVEE

SEQ ID NO: 2197 - protein, 42 aa, Artificial Sequence
  chemically synthesized
SQVSPFKIPIEELEDRVHVNCQTSIYRASSLSNCRHTSSVEE

SEQ ID NO: 2198 - protein, 42 aa, Artificial Sequence
  chemically synthesized
SQVSPFKIPIEELEDRVMVNCQTSIYRASSLSNCRHTSSVEE

SEQ ID NO: 2199 - protein, 42 aa, Artificial Sequence; identical to SEQ ID NO: 1845
  chemically synthesized

SEQ ID NO: 2200 - protein, 42 aa, Artificial Sequence
  chemically synthesized
SQVSPFKIPIEELEDRVFLNCQTSIYRASSLSNCRHTSSVEE

SEQ ID NO: 2201 - protein, 42 aa, Artificial Sequence
  chemically synthesized
SQVSPFKIPIEELEDRVFFNCQTSIYRASSLSNCRHTSSVEE

SEQ ID NO: 2202 - protein, 42 aa, Artificial Sequence
  chemically synthesized
SQVSPFKIPIEELEDRVFHNCQTSIYRASSLSNCRHTSSVEE

SEQ ID NO: 2203 - protein, 42 aa, Artificial Sequence
  chemically synthesized
SQVSPFKIPIEELEDRVFMNCQTSIYRASSLSNCRHTSSVEE

SEQ ID NO: 2204 - protein, 42 aa, Artificial Sequence; identical to SEQ ID NO: 1966
  chemically synthesized

SEQ ID NO: 2205 - protein, 42 aa, Artificial Sequence
  chemically synthesized
SQVSPFKIPIEELEDRVFVNSQTSIYRASSLSNCRHTSSVEE

SEQ ID NO: 2206 - protein, 42 aa, Artificial Sequence
  chemically synthesized
SQVSPFKIPIEELEDRVFVNGQTSIYRASSLSNCRHTSSVEE

SEQ ID NO: 2207 - protein, 42 aa, Artificial Sequence
  chemically synthesized
SQVSPFKIPIEELEDRVFVNAQTSIYRASSLSNCRHTSSVEE

SEQ ID NO: 2208 - protein, 42 aa, Artificial Sequence
  chemically synthesized
SQVSPFKIPIEELEDRVFVNCQSSIYRASSLSNCRHTSSVEE

SEQ ID NO: 2209 - protein, 42 aa, Artificial Sequence
  chemically synthesized
SQVSPFKIPIEELEDRVFVNCQYSIYRASSLSNCRHTSSVEE

SEQ ID NO: 2210 - protein, 42 aa, Artificial Sequence
  chemically synthesized
SQVSPFKIPIEELEDRVFVNCQTTIYRASSLSNCRHTSSVEE

SEQ ID NO: 2211 - protein, 42 aa, Artificial Sequence
  chemically synthesized
SQVSPFKIPIEELEDRVFVNCQTYIYRASSLSNCRHTSSVEE

SEQ ID NO: 2212 - protein, 42 aa, Artificial Sequence
  chemically synthesized
SQVSPFKIPIEELEDRVFVNCQTSVYRASSLSNCRHTSSVEE

SEQ ID NO: 2213 - protein, 42 aa, Artificial Sequence
  chemically synthesized
SQVSPFKIPIEELEDRVFVNCQTSLYRASSLSNCRHTSSVEE

SEQ ID NO: 2214 - protein, 42 aa, Artificial Sequence
  chemically synthesized
SQVSPFKIPIEELEDRVFVNCQTSHYRASSLSNCRHTSSVEE

SEQ ID NO: 2215 - protein, 42 aa, Artificial Sequence
  chemically synthesized
SQVSPFKIPIEELEDRVFVNCQTSFYRASSLSNCRHTSSVEE

SEQ ID NO: 2216 - protein, 42 aa, Artificial Sequence
  chemically synthesized
SQVSPFKIPIEELEDRVFVNCQTSMYRASSLSNCRHTSSVEE

SEQ ID NO: 2217 - protein, 42 aa, Artificial Sequence
  chemically synthesized
SQVSPFKIPIEELEDRVFVNCQTSIWRASSLSNCRHTSSVEE

SEQ ID NO: 2218 - protein, 42 aa, Artificial Sequence
  chemically synthesized
SQVSPFKIPIEELEDRVFVNCQTSIFRASSLSNCRHTSSVEE

SEQ ID NO: 2219 - protein, 42 aa, Artificial Sequence
  chemically synthesized
SQVSPFKIPIEELEDRVFVNCQTSISRASSLSNCRHTSSVEE

SEQ ID NO: 2220 - protein, 42 aa, Artificial Sequence
  chemically synthesized
SQVSPFKIPIEELEDRVFVNCQTSITRASSLSNCRHTSSVEE

SEQ ID NO: 2221 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCQTSIYXASSLSNCRHTSSVEE

SEQ ID NO: 2222 - protein, 42 aa, Artificial Sequence
  chemically synthesized
SQVSPFKIPIEELEDRVFVNCQTSIYHASSLSNCRHTSSVEE

SEQ ID NO: 2223 - protein, 42 aa, Artificial Sequence
  chemically synthesized
SQVSPFKIPIEELEDRVFVNCQTSIYKASSLSNCRHTSSVEE

SEQ ID NO: 2224 - protein, 42 aa, Artificial Sequence
  chemically synthesized
SQVSPFKIPIEELEDRVFVNCQTSIYRGSSLSNCRHTSSVEE

SEQ ID NO: 2225 - protein, 42 aa, Artificial Sequence
  chemically synthesized
SQVSPFKIPIEELEDRVFVNCQTSIYRATSLSNCRHTSSVEE

SEQ ID NO: 2226 - protein, 42 aa, Artificial Sequence
  chemically synthesized
SQVSPFKIPIEELEDRVFVNCQTSIYRAYSLSNCRHTSSVEE

SEQ ID NO: 2227 - protein, 42 aa, Artificial Sequence
  chemically synthesized
SQVSPFKIPIEELEDRVFVNCQTSIYRASTLSNCRHTSSVEE

SEQ ID NO: 2228 - protein, 42 aa, Artificial Sequence
  chemically synthesized
SQVSPFKIPIEELEDRVFVNCQTSIYRASYLSNCRHTSSVEE

SEQ ID NO: 2229 - protein, 42 aa, Artificial Sequence
  chemically synthesized
SQVSPFKIPIEELEDRVFVNCQTSIYRASSISNCRHTSSVEE

SEQ ID NO: 2230 - protein, 42 aa, Artificial Sequence
  chemically synthesized
SQVSPFKIPIEELEDRVFVNCQTSIYRASSVSNCRHTSSVEE

SEQ ID NO: 2231 - protein, 42 aa, Artificial Sequence
  chemically synthesized
SQVSPFKIPIEELEDRVFVNCQTSIYRASSFSNCRHTSSVEE

SEQ ID NO: 2232 - protein, 42 aa, Artificial Sequence
  chemically synthesized
SQVSPFKIPIEELEDRVFVNCQTSIYRASSMSNCRHTSSVEE

SEQ ID NO: 2233 - protein, 42 aa, Artificial Sequence
  chemically synthesized
SQVSPFKIPIEELEDRVFVNCQTSIYRASSHSNCRHTSSVEE

SEQ ID NO: 2234 - protein, 42 aa, Artificial Sequence
  chemically synthesized
SQVSPFKIPIEELEDRVFVNCQTSIYRASSLTNCRHTSSVEE

SEQ ID NO: 2235 - protein, 42 aa, Artificial Sequence
  chemically synthesized
SQVSPFKIPIEELEDRVFVNCQTSIYRASSLYNCRHTSSVEE

SEQ ID NO: 2236 - protein, 42 aa, Artificial Sequence
  chemically synthesized
SQVSPFKIPIEELEDRVFVNCQTSIYRASSLSQCRHTSSVEE

SEQ ID NO: 2237 - protein, 42 aa, Artificial Sequence
  chemically synthesized
SQVSPFKIPIEELEDRVFVNCQTSIYRASSLSNSRHTSSVEE

SEQ ID NO: 2238 - protein, 42 aa, Artificial Sequence
  chemically synthesized
SQVSPFKIPIEELEDRVFVNCQTSIYRASSLSNGRHTSSVEE

SEQ ID NO: 2239 - protein, 42 aa, Artificial Sequence
  chemically synthesized
SQVSPFKIPIEELEDRVFVNCQTSIYRASSLSNARHTSSVEE

SEQ ID NO: 2240 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCQTSIYRASSLSNCXHTSSVEE

SEQ ID NO: 2241 - protein, 42 aa, Artificial Sequence
  chemically synthesized
SQVSPFKIPIEELEDRVFVNCQTSIYRASSLSNCHHTSSVEE

SEQ ID NO: 2242 - protein, 42 aa, Artificial Sequence
  chemically synthesized
SQVSPFKIPIEELEDRVFVNCQTSIYRASSLSNCKHTSSVEE

SEQ ID NO: 2243 - protein, 42 aa, Artificial Sequence
  chemically synthesized
SQVSPFKIPIEELEDRVFVNCQTSIYRASSLSNCRGTSSVEE

SEQ ID NO: 2244 - protein, 42 aa, Artificial Sequence
  chemically synthesized
SQVSPFKIPIEELEDRVFVNCQTSIYRASSLSNCRATSSVEE

SEQ ID NO: 2245 - protein, 42 aa, Artificial Sequence
  chemically synthesized
SQVSPFKIPIEELEDRVFVNCQTSIYRASSLSNCRITSSVEE

SEQ ID NO: 2246 - protein, 42 aa, Artificial Sequence
  chemically synthesized
SQVSPFKIPIEELEDRVFVNCQTSIYRASSLSNCRLTSSVEE

SEQ ID NO: 2247 - protein, 42 aa, Artificial Sequence
  chemically synthesized
SQVSPFKIPIEELEDRVFVNCQTSIYRASSLSNCRMTSSVEE

SEQ ID NO: 2248 - protein, 42 aa, Artificial Sequence
  chemically synthesized
SQVSPFKIPIEELEDRVFVNCQTSIYRASSLSNCRVTSSVEE

SEQ ID NO: 2249 - protein, 42 aa, Artificial Sequence
  chemically synthesized
SQVSPFKIPIEELEDRVFVNCQTSIYRASSLSNCRHSSSVEE

SEQ ID NO: 2250 - protein, 42 aa, Artificial Sequence
  chemically synthesized
SQVSPFKIPIEELEDRVFVNCQTSIYRASSLSNCRHYSSVEE

SEQ ID NO: 2251 - protein, 42 aa, Artificial Sequence
  chemically synthesized
SQVSPFKIPIEELEDRVFVNCQTSIYRASSLSNCRHTTSVEE

SEQ ID NO: 2252 - protein, 42 aa, Artificial Sequence
  chemically synthesized
SQVSPFKIPIEELEDRVFVNCQTSIYRASSLSNCRHTYSVEE

SEQ ID NO: 2253 - protein, 42 aa, Artificial Sequence
  chemically synthesized
SQVSPFKIPIEELEDRVFVNCQTSIYRASSLSNCRHTSTVEE

SEQ ID NO: 2254 - protein, 42 aa, Artificial Sequence
  chemically synthesized
SQVSPFKIPIEELEDRVFVNCQTSIYRASSLSNCRHTSYVEE

SEQ ID NO: 2255 - protein, 42 aa, Artificial Sequence
  chemically synthesized
SQVSPFKIPIEELEDRVFVNCQTSIYRASSLSNCRHTSSIEE

SEQ ID NO: 2256 - protein, 42 aa, Artificial Sequence
  chemically synthesized
SQVSPFKIPIEELEDRVFVNCQTSIYRASSLSNCRHTSSLEE

SEQ ID NO: 2257 - protein, 42 aa, Artificial Sequence
  chemically synthesized
SQVSPFKIPIEELEDRVFVNCQTSIYRASSLSNCRHTSSFEE

SEQ ID NO: 2258 - protein, 42 aa, Artificial Sequence
  chemically synthesized
SQVSPFKIPIEELEDRVFVNCQTSIYRASSLSNCRHTSSHEE

SEQ ID NO: 2259 - protein, 42 aa, Artificial Sequence
  chemically synthesized
SQVSPFKIPIEELEDRVFVNCQTSIYRASSLSNCRHTSSMEE

SEQ ID NO: 2260 - protein, 42 aa, Artificial Sequence
  chemically synthesized
SQVSPFKIPIEELEDRVFVNCQTSIYRASSLSNCRHTSSVDE

SEQ ID NO: 2261 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCQTSIYRASSLSNCRHTSSVXE

SEQ ID NO: 2262 - protein, 42 aa, Artificial Sequence
  chemically synthesized
SQVSPFKIPIEELEDRVFVNCQTSIYRASSLSNCRHTSSVED

SEQ ID NO: 2263 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCQTSIYRASSLSNCRHTSSVEX

SEQ ID NO: 2264 - protein, 42 aa, Artificial Sequence
  chemically synthesized
SQVSAFKIPIEELEDRVFVNCQTSIYRASSLSNCRHTSSVEE

SEQ ID NO: 2265 - protein, 42 aa, Artificial Sequence
  chemically synthesized
SQVSGFKIPIEELEDRVFVNCQTSIYRASSLSNCRHTSSVEE

SEQ ID NO: 2266 - protein, 42 aa, Artificial Sequence
  chemically synthesized
SQVSPFKIAIEELEDRVFVNCQTSIYRASSLSNCRHTSSVEE

SEQ ID NO: 2267 - protein, 42 aa, Artificial Sequence
  chemically synthesized
SQVSPFKIGIEELEDRVFVNCQTSIYRASSLSNCRHTSSVEE

SEQ ID NO: 2268 - protein, 42 aa, Artificial Sequence; identical to SEQ ID NO: 66
  chemically synthesized

SEQ ID NO: 2269 - protein, 42 aa, Artificial Sequence; identical to SEQ ID NO: 185
  chemically synthesized

SEQ ID NO: 2270 - protein, 42 aa, Artificial Sequence
  chemically synthesized
YQVSPFKIPIEELEDRVFVNCNSSIYRASSLSNCRHTSSVEE

SEQ ID NO: 2271 - protein, 42 aa, Artificial Sequence; identical to SEQ ID NO: 305
  chemically synthesized

SEQ ID NO: 2272 - protein, 42 aa, Artificial Sequence; identical to SEQ ID NO: 423
  chemically synthesized

SEQ ID NO: 2273 - protein, 42 aa, Artificial Sequence
  chemically synthesized
SQISPFKIPIEELEDRVFVNCNSSIYRASSLSNCRHTSSVEE

SEQ ID NO: 2274 - protein, 42 aa, Artificial Sequence
  chemically synthesized
SQPSPFKIPIEELEDRVFVNCNSSIYRASSLSNCRHTSSVEE

SEQ ID NO: 2275 - protein, 42 aa, Artificial Sequence
  chemically synthesized
SQFSPFKIPIEELEDRVFVNCNSSIYRASSLSNCRHTSSVEE

SEQ ID NO: 2276 - protein, 42 aa, Artificial Sequence; identical to SEQ ID NO: 542
  chemically synthesized

SEQ ID NO: 2277 - protein, 42 aa, Artificial Sequence
  chemically synthesized
SQVYPFKIPIEELEDRVFVNCNSSIYRASSLSNCRHTSSVEE

SEQ ID NO: 2278 - protein, 42 aa, Artificial Sequence
  chemically synthesized
SQVSPWKIPIEELEDRVFVNCNSSIYRASSLSNCRHTSSVEE

SEQ ID NO: 2279 - protein, 42 aa, Artificial Sequence
  chemically synthesized
SQVSPYKIPIEELEDRVFVNCNSSIYRASSLSNCRHTSSVEE

SEQ ID NO: 2280 - protein, 42 aa, Artificial Sequence
  chemically synthesized
SQVSPHKIPIEELEDRVFVNCNSSIYRASSLSNCRHTSSVEE

SEQ ID NO: 2281 - protein, 42 aa, Artificial Sequence
  chemically synthesized
SQVSPFRIPIEELEDRVFVNCNSSIYRASSLSNCRHTSSVEE

SEQ ID NO: 2282 - protein, 42 aa, Artificial Sequence
  chemically synthesized
SQVSPFHIPIEELEDRVFVNCNSSIYRASSLSNCRHTSSVEE

SEQ ID NO: 2283 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNSSIYRASSLSNCRHTSSVEE

SEQ ID NO: 2284 - protein, 42 aa, Artificial Sequence; identical to SEQ ID NO: 781
  chemically synthesized

SEQ ID NO: 2285 - protein, 42 aa, Artificial Sequence
  chemically synthesized
SQVSPFKHPIEELEDRVFVNCNSSIYRASSLSNCRHTSSVEE

SEQ ID NO: 2286 - protein, 42 aa, Artificial Sequence
  chemically synthesized
SQVSPFKVPIEELEDRVFVNCNSSIYRASSLSNCRHTSSVEE

SEQ ID NO: 2287 - protein, 42 aa, Artificial Sequence
  chemically synthesized
SQVSPFKFPIEELEDRVFVNCNSSIYRASSLSNCRHTSSVEE

SEQ ID NO: 2288 - protein, 42 aa, Artificial Sequence
  chemically synthesized
SQVSPFKMPIEELEDRVFVNCNSSIYRASSLSNCRHTSSVEE

SEQ ID NO: 2289 - protein, 42 aa, Artificial Sequence; identical to SEQ ID NO: 899
  chemically synthesized

SEQ ID NO: 2290 - protein, 42 aa, Artificial Sequence
  chemically synthesized
SQVSPFKIPHEELEDRVFVNCNSSIYRASSLSNCRHTSSVEE

SEQ ID NO: 2291 - protein, 42 aa, Artificial Sequence
  chemically synthesized
SQVSPFKIPVEELEDRVFVNCNSSIYRASSLSNCRHTSSVEE

SEQ ID NO: 2292 - protein, 42 aa, Artificial Sequence
  chemically synthesized
SQVSPFKIPFEELEDRVFVNCNSSIYRASSLSNCRHTSSVEE

SEQ ID NO: 2293 - protein, 42 aa, Artificial Sequence
  chemically synthesized
SQVSPFKIPMEELEDRVFVNCNSSIYRASSLSNCRHTSSVEE

SEQ ID NO: 2294 - protein, 42 aa, Artificial Sequence; identical to SEQ ID NO: 1019
  chemically synthesized

SEQ ID NO: 2295 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNSSIYRASSLSNCRHTSSVEE

SEQ ID NO: 2296 - protein, 42 aa, Artificial Sequence; identical to SEQ ID NO: 1139
  chemically synthesized

SEQ ID NO: 2297 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNSSIYRASSLSNCRHTSSVEE

SEQ ID NO: 2298 - protein, 42 aa, Artificial Sequence
  chemically synthesized
SQVSPFKIPIEEVEDRVFVNCNSSIYRASSLSNCRHTSSVEE

SEQ ID NO: 2299 - protein, 42 aa, Artificial Sequence; identical to SEQ ID NO: 1256
  chemically synthesized

SEQ ID NO: 2300 - protein, 42 aa, Artificial Sequence
  chemically synthesized
SQVSPFKIPIEEFEDRVFVNCNSSIYRASSLSNCRHTSSVEE

SEQ ID NO: 2301 - protein, 42 aa, Artificial Sequence
  chemically synthesized
SQVSPFKIPIEEHEDRVFVNCNSSIYRASSLSNCRHTSSVEE

SEQ ID NO: 2302 - protein, 42 aa, Artificial Sequence
  chemically synthesized
SQVSPFKIPIEEMEDRVFVNCNSSIYRASSLSNCRHTSSVEE

SEQ ID NO: 2303 - protein, 42 aa, Artificial Sequence; identical to SEQ ID NO: 1376
  chemically synthesized

SEQ ID NO: 2304 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNSSIYRASSLSNCRHTSSVEE

SEQ ID NO: 2305 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNSSIYRASSLSNCRHTSSVEE

SEQ ID NO: 2306 - protein, 42 aa, Artificial Sequence
  chemically synthesized
SQVSPFKIPIEELEERVFVNCNSSIYRASSLSNCRHTSSVEE

SEQ ID NO: 2307 - protein, 42 aa, Artificial Sequence; identical to SEQ ID NO: 1495
  chemically synthesized

SEQ ID NO: 2308 - protein, 42 aa, Artificial Sequence
  chemically synthesized
SQVSPFKIPIEELEDHVFVNCNSSIYRASSLSNCRHTSSVEE

SEQ ID NO: 2309 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNSSIYRASSLSNCRHTSSVEE

SEQ ID NO: 2310 - protein, 42 aa, Artificial Sequence; identical to SEQ ID NO: 1612
  chemically synthesized

SEQ ID NO: 2311 - protein, 42 aa, Artificial Sequence
  chemically synthesized
SQVSPFKIPIEELEDRLFVNCNSSIYRASSLSNCRHTSSVEE

SEQ ID NO: 2312 - protein, 42 aa, Artificial Sequence
  chemically synthesized
SQVSPFKIPIEELEDRFFVNCNSSIYRASSLSNCRHTSSVEE

SEQ ID NO: 2313 - protein, 42 aa, Artificial Sequence
  chemically synthesized
SQVSPFKIPIEELEDRHFVNCNSSIYRASSLSNCRHTSSVEE

SEQ ID NO: 2314 - protein, 42 aa, Artificial Sequence
  chemically synthesized
SQVSPFKIPIEELEDRMFVNCNSSIYRASSLSNCRHTSSVEE

SEQ ID NO: 2315 - protein, 42 aa, Artificial Sequence; identical to SEQ ID NO: 1729
  chemically synthesized

SEQ ID NO: 2316 - protein, 42 aa, Artificial Sequence
  chemically synthesized
SQVSPFKIPIEELEDRVLVNCNSSIYRASSLSNCRHTSSVEE

SEQ ID NO: 2317 - protein, 42 aa, Artificial Sequence
  chemically synthesized
SQVSPFKIPIEELEDRVVVNCNSSIYRASSLSNCRHTSSVEE

SEQ ID NO: 2318 - protein, 42 aa, Artificial Sequence
  chemically synthesized
SQVSPFKIPIEELEDRVHVNCNSSIYRASSLSNCRHTSSVEE

SEQ ID NO: 2319 - protein, 42 aa, Artificial Sequence
  chemically synthesized
SQVSPFKIPIEELEDRVMVNCNSSIYRASSLSNCRHTSSVEE

SEQ ID NO: 2320 - protein, 42 aa, Artificial Sequence; identical to SEQ ID NO: 1846
  chemically synthesized

SEQ ID NO: 2321 - protein, 42 aa, Artificial Sequence
  chemically synthesized
SQVSPFKIPIEELEDRVFLNCNSSIYRASSLSNCRHTSSVEE

SEQ ID NO: 2322 - protein, 42 aa, Artificial Sequence
  chemically synthesized
SQVSPFKIPIEELEDRVFFNCNSSIYRASSLSNCRHTSSVEE

SEQ ID NO: 2323 - protein, 42 aa, Artificial Sequence
  chemically synthesized
SQVSPFKIPIEELEDRVFHNCNSSIYRASSLSNCRHTSSVEE

SEQ ID NO: 2324 - protein, 42 aa, Artificial Sequence
  chemically synthesized
SQVSPFKIPIEELEDRVFMNCNSSIYRASSLSNCRHTSSVEE

SEQ ID NO: 2325 - protein, 42 aa, Artificial Sequence; identical to SEQ ID NO: 1967
  chemically synthesized

SEQ ID NO: 2326 - protein, 42 aa, Artificial Sequence
  chemically synthesized
SQVSPFKIPIEELEDRVFVNSNSSIYRASSLSNCRHTSSVEE

SEQ ID NO: 2327 - protein, 42 aa, Artificial Sequence
  chemically synthesized
SQVSPFKIPIEELEDRVFVNGNSSIYRASSLSNCRHTSSVEE

SEQ ID NO: 2328 - protein, 42 aa, Artificial Sequence
  chemically synthesized
SQVSPFKIPIEELEDRVFVNANSSIYRASSLSNCRHTSSVEE

SEQ ID NO: 2329 - protein, 42 aa, Artificial Sequence; identical to SEQ ID NO: 2208
  chemically synthesized

SEQ ID NO: 2330 - protein, 42 aa, Artificial Sequence
  chemically synthesized
SQVSPFKIPIEELEDRVFVNCNSTIYRASSLSNCRHTSSVEE

SEQ ID NO: 2331 - protein, 42 aa, Artificial Sequence
  chemically synthesized
SQVSPFKIPIEELEDRVFVNCNSYIYRASSLSNCRHTSSVEE

SEQ ID NO: 2332 - protein, 42 aa, Artificial Sequence
  chemically synthesized
SQVSPFKIPIEELEDRVFVNCNSSVYRASSLSNCRHTSSVEE

SEQ ID NO: 2333 - protein, 42 aa, Artificial Sequence
  chemically synthesized
SQVSPFKIPIEELEDRVFVNCNSSLYRASSLSNCRHTSSVEE

SEQ ID NO: 2334 - protein, 42 aa, Artificial Sequence
  chemically synthesized
SQVSPFKIPIEELEDRVFVNCNSSHYRASSLSNCRHTSSVEE

SEQ ID NO: 2335 - protein, 42 aa, Artificial Sequence
  chemically synthesized
SQVSPFKIPIEELEDRVFVNCNSSFYRASSLSNCRHTSSVEE

SEQ ID NO: 2336 - protein, 42 aa, Artificial Sequence
  chemically synthesized
SQVSPFKIPIEELEDRVFVNCNSSMYRASSLSNCRHTSSVEE

SEQ ID NO: 2337 - protein, 42 aa, Artificial Sequence
  chemically synthesized
SQVSPFKIPIEELEDRVFVNCNSSIWRASSLSNCRHTSSVEE

SEQ ID NO: 2338 - protein, 42 aa, Artificial Sequence
  chemically synthesized
SQVSPFKIPIEELEDRVFVNCNSSIFRASSLSNCRHTSSVEE

SEQ ID NO: 2339 - protein, 42 aa, Artificial Sequence
  chemically synthesized
SQVSPFKIPIEELEDRVFVNCNSSISRASSLSNCRHTSSVEE

SEQ ID NO: 2340 - protein, 42 aa, Artificial Sequence
  chemically synthesized
SQVSPFKIPIEELEDRVFVNCNSSITRASSLSNCRHTSSVEE

SEQ ID NO: 2341 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNSSIYXASSLSNCRHTSSVEE

SEQ ID NO: 2342 - protein, 42 aa, Artificial Sequence
  chemically synthesized
SQVSPFKIPIEELEDRVFVNCNSSIYHASSLSNCRHTSSVEE

SEQ ID NO: 2343 - protein, 42 aa, Artificial Sequence
  chemically synthesized
SQVSPFKIPIEELEDRVFVNCNSSIYKASSLSNCRHTSSVEE

SEQ ID NO: 2344 - protein, 42 aa, Artificial Sequence
  chemically synthesized
SQVSPFKIPIEELEDRVFVNCNSSIYRGSSLSNCRHTSSVEE

SEQ ID NO: 2345 - protein, 42 aa, Artificial Sequence
  chemically synthesized
SQVSPFKIPIEELEDRVFVNCNSSIYRATSLSNCRHTSSVEE

SEQ ID NO: 2346 - protein, 42 aa, Artificial Sequence
  chemically synthesized
SQVSPFKIPIEELEDRVFVNCNSSIYRAYSLSNCRHTSSVEE

SEQ ID NO: 2347 - protein, 42 aa, Artificial Sequence
  chemically synthesized
SQVSPFKIPIEELEDRVFVNCNSSIYRASTLSNCRHTSSVEE

SEQ ID NO: 2348 - protein, 42 aa, Artificial Sequence
  chemically synthesized
SQVSPFKIPIEELEDRVFVNCNSSIYRASYLSNCRHTSSVEE

SEQ ID NO: 2349 - protein, 42 aa, Artificial Sequence
  chemically synthesized
SQVSPFKIPIEELEDRVFVNCNSSIYRASSISNCRHTSSVEE

SEQ ID NO: 2350 - protein, 42 aa, Artificial Sequence
  chemically synthesized
SQVSPFKIPIEELEDRVFVNCNSSIYRASSVSNCRHTSSVEE

SEQ ID NO: 2351 - protein, 42 aa, Artificial Sequence
  chemically synthesized
SQVSPFKIPIEELEDRVFVNCNSSIYRASSFSNCRHTSSVEE

SEQ ID NO: 2352 - protein, 42 aa, Artificial Sequence
  chemically synthesized
SQVSPFKIPIEELEDRVFVNCNSSIYRASSMSNCRHTSSVEE

SEQ ID NO: 2353 - protein, 42 aa, Artificial Sequence
  chemically synthesized
SQVSPFKIPIEELEDRVFVNCNSSIYRASSHSNCRHTSSVEE

SEQ ID NO: 2354 - protein, 42 aa, Artificial Sequence
  chemically synthesized
SQVSPFKIPIEELEDRVFVNCNSSIYRASSLTNCRHTSSVEE

SEQ ID NO: 2355 - protein, 42 aa, Artificial Sequence
  chemically synthesized
SQVSPFKIPIEELEDRVFVNCNSSIYRASSLYNCRHTSSVEE

SEQ ID NO: 2356 - protein, 42 aa, Artificial Sequence
  chemically synthesized
SQVSPFKIPIEELEDRVFVNCNSSIYRASSLSQCRHTSSVEE

SEQ ID NO: 2357 - protein, 42 aa, Artificial Sequence
  chemically synthesized
SQVSPFKIPIEELEDRVFVNCNSSIYRASSLSNSRHTSSVEE

SEQ ID NO: 2358 - protein, 42 aa, Artificial Sequence
  chemically synthesized
SQVSPFKIPIEELEDRVFVNCNSSIYRASSLSNGRHTSSVEE

SEQ ID NO: 2359 - protein, 42 aa, Artificial Sequence
  chemically synthesized
SQVSPFKIPIEELEDRVFVNCNSSIYRASSLSNARHTSSVEE

SEQ ID NO: 2360 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNSSIYRASSLSNCXHTSSVEE

SEQ ID NO: 2361 - protein, 42 aa, Artificial Sequence
  chemically synthesized
SQVSPFKIPIEELEDRVFVNCNSSIYRASSLSNCHHTSSVEE

SEQ ID NO: 2362 - protein, 42 aa, Artificial Sequence
  chemically synthesized
SQVSPFKIPIEELEDRVFVNCNSSIYRASSLSNCKHTSSVEE

SEQ ID NO: 2363 - protein, 42 aa, Artificial Sequence
  chemically synthesized
SQVSPFKIPIEELEDRVFVNCNSSIYRASSLSNCRGTSSVEE

SEQ ID NO: 2364 - protein, 42 aa, Artificial Sequence
  chemically synthesized
SQVSPFKIPIEELEDRVFVNCNSSIYRASSLSNCRATSSVEE

SEQ ID NO: 2365 - protein, 42 aa, Artificial Sequence
  chemically synthesized
SQVSPFKIPIEELEDRVFVNCNSSIYRASSLSNCRITSSVEE

SEQ ID NO: 2366 - protein, 42 aa, Artificial Sequence
  chemically synthesized
SQVSPFKIPIEELEDRVFVNCNSSIYRASSLSNCRLTSSVEE

SEQ ID NO: 2367 - protein, 42 aa, Artificial Sequence
  chemically synthesized
SQVSPFKIPIEELEDRVFVNCNSSIYRASSLSNCRMTSSVEE

SEQ ID NO: 2368 - protein, 42 aa, Artificial Sequence
  chemically synthesized
SQVSPFKIPIEELEDRVFVNCNSSIYRASSLSNCRVTSSVEE

SEQ ID NO: 2369 - protein, 42 aa, Artificial Sequence
  chemically synthesized
SQVSPFKIPIEELEDRVFVNCNSSIYRASSLSNCRHSSSVEE

SEQ ID NO: 2370 - protein, 42 aa, Artificial Sequence
  chemically synthesized
SQVSPFKIPIEELEDRVFVNCNSSIYRASSLSNCRHYSSVEE

SEQ ID NO: 2371 - protein, 42 aa, Artificial Sequence
  chemically synthesized
SQVSPFKIPIEELEDRVFVNCNSSIYRASSLSNCRHTTSVEE

SEQ ID NO: 2372 - protein, 42 aa, Artificial Sequence
  chemically synthesized
SQVSPFKIPIEELEDRVFVNCNSSIYRASSLSNCRHTYSVEE

SEQ ID NO: 2373 - protein, 42 aa, Artificial Sequence
  chemically synthesized
SQVSPFKIPIEELEDRVFVNCNSSIYRASSLSNCRHTSTVEE

SEQ ID NO: 2374 - protein, 42 aa, Artificial Sequence
  chemically synthesized
SQVSPFKIPIEELEDRVFVNCNSSIYRASSLSNCRHTSYVEE

SEQ ID NO: 2375 - protein, 42 aa, Artificial Sequence
  chemically synthesized
SQVSPFKIPIEELEDRVFVNCNSSIYRASSLSNCRHTSSIEE

SEQ ID NO: 2376 - protein, 42 aa, Artificial Sequence
  chemically synthesized
SQVSPFKIPIEELEDRVFVNCNSSIYRASSLSNCRHTSSLEE

SEQ ID NO: 2377 - protein, 42 aa, Artificial Sequence
  chemically synthesized
SQVSPFKIPIEELEDRVFVNCNSSIYRASSLSNCRHTSSFEE

SEQ ID NO: 2378 - protein, 42 aa, Artificial Sequence
  chemically synthesized
SQVSPFKIPIEELEDRVFVNCNSSIYRASSLSNCRHTSSHEE

SEQ ID NO: 2379 - protein, 42 aa, Artificial Sequence
  chemically synthesized
SQVSPFKIPIEELEDRVFVNCNSSIYRASSLSNCRHTSSMEE

SEQ ID NO: 2380 - protein, 42 aa, Artificial Sequence
  chemically synthesized
SQVSPFKIPIEELEDRVFVNCNSSIYRASSLSNCRHTSSVDE

SEQ ID NO: 2381 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNSSIYRASSLSNCRHTSSVXE

SEQ ID NO: 2382 - protein, 42 aa, Artificial Sequence
  chemically synthesized
SQVSPFKIPIEELEDRVFVNCNSSIYRASSLSNCRHTSSVED

SEQ ID NO: 2383 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNSSIYRASSLSNCRHTSSVEX

SEQ ID NO: 2384 - protein, 42 aa, Artificial Sequence
  chemically synthesized
SQVSAFKIPIEELEDRVFVNCNSSIYRASSLSNCRHTSSVEE

SEQ ID NO: 2385 - protein, 42 aa, Artificial Sequence
  chemically synthesized
SQVSGFKIPIEELEDRVFVNCNSSIYRASSLSNCRHTSSVEE

SEQ ID NO: 2386 - protein, 42 aa, Artificial Sequence
  chemically synthesized
SQVSPFKIAIEELEDRVFVNCNSSIYRASSLSNCRHTSSVEE

SEQ ID NO: 2387 - protein, 42 aa, Artificial Sequence
  chemically synthesized
SQVSPFKIGIEELEDRVFVNCNSSIYRASSLSNCRHTSSVEE

SEQ ID NO: 2388 - protein, 42 aa, Artificial Sequence; identical to SEQ ID NO: 68
  chemically synthesized

SEQ ID NO: 2389 - protein, 42 aa, Artificial Sequence; identical to SEQ ID NO: 187
  chemically synthesized

SEQ ID NO: 2390 - protein, 42 aa, Artificial Sequence
  chemically synthesized
YQVSPFKIPIEELEDRVFVNCNTTIYRASSLSNCRHTSSVEE

SEQ ID NO: 2391 - protein, 42 aa, Artificial Sequence; identical to SEQ ID NO: 307
  chemically synthesized

SEQ ID NO: 2392 - protein, 42 aa, Artificial Sequence; identical to SEQ ID NO: 425
  chemically synthesized

SEQ ID NO: 2393 - protein, 42 aa, Artificial Sequence
  chemically synthesized
SQISPFKIPIEELEDRVFVNCNTTIYRASSLSNCRHTSSVEE

SEQ ID NO: 2394 - protein, 42 aa, Artificial Sequence
  chemically synthesized
SQPSPFKIPIEELEDRVFVNCNTTIYRASSLSNCRHTSSVEE

SEQ ID NO: 2395 - protein, 42 aa, Artificial Sequence
  chemically synthesized
SQFSPFKIPIEELEDRVFVNCNTTIYRASSLSNCRHTSSVEE

SEQ ID NO: 2396 - protein, 42 aa, Artificial Sequence; identical to SEQ ID NO: 544
  chemically synthesized

SEQ ID NO: 2397 - protein, 42 aa, Artificial Sequence
  chemically synthesized
SQVYPFKIPIEELEDRVFVNCNTTIYRASSLSNCRHTSSVEE

SEQ ID NO: 2398 - protein, 42 aa, Artificial Sequence
  chemically synthesized
SQVSPWKIPIEELEDRVFVNCNTTIYRASSLSNCRHTSSVEE

SEQ ID NO: 2399 - protein, 42 aa, Artificial Sequence
  chemically synthesized
SQVSPYKIPIEELEDRVFVNCNTTIYRASSLSNCRHTSSVEE

SEQ ID NO: 2400 - protein, 42 aa, Artificial Sequence
  chemically synthesized
SQVSPHKIPIEELEDRVFVNCNTTIYRASSLSNCRHTSSVEE

SEQ ID NO: 2401 - protein, 42 aa, Artificial Sequence
  chemically synthesized
SQVSPFRIPIEELEDRVFVNCNTTIYRASSLSNCRHTSSVEE

SEQ ID NO: 2402 - protein, 42 aa, Artificial Sequence
  chemically synthesized
SQVSPFHIPIEELEDRVFVNCNTTIYRASSLSNCRHTSSVEE

SEQ ID NO: 2403 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTTIYRASSLSNCRHTSSVEE

SEQ ID NO: 2404 - protein, 42 aa, Artificial Sequence; identical to SEQ ID NO: 783
  chemically synthesized

SEQ ID NO: 2405 - protein, 42 aa, Artificial Sequence
  chemically synthesized
SQVSPFKHPIEELEDRVFVNCNTTIYRASSLSNCRHTSSVEE

SEQ ID NO: 2406 - protein, 42 aa, Artificial Sequence
  chemically synthesized
SQVSPFKVPIEELEDRVFVNCNTTIYRASSLSNCRHTSSVEE

SEQ ID NO: 2407 - protein, 42 aa, Artificial Sequence
  chemically synthesized
SQVSPFKFPIEELEDRVFVNCNTTIYRASSLSNCRHTSSVEE

SEQ ID NO: 2408 - protein, 42 aa, Artificial Sequence
  chemically synthesized
SQVSPFKMPIEELEDRVFVNCNTTIYRASSLSNCRHTSSVEE

SEQ ID NO: 2409 - protein, 42 aa, Artificial Sequence; identical to SEQ ID NO: 901
  chemically synthesized

SEQ ID NO: 2410 - protein, 42 aa, Artificial Sequence
  chemically synthesized
SQVSPFKIPHEELEDRVFVNCNTTIYRASSLSNCRHTSSVEE

SEQ ID NO: 2411 - protein, 42 aa, Artificial Sequence
  chemically synthesized
SQVSPFKIPVEELEDRVFVNCNTTIYRASSLSNCRHTSSVEE

SEQ ID NO: 2412 - protein, 42 aa, Artificial Sequence
  chemically synthesized
SQVSPFKIPFEELEDRVFVNCNTTIYRASSLSNCRHTSSVEE

SEQ ID NO: 2413 - protein, 42 aa, Artificial Sequence
  chemically synthesized
SQVSPFKIPMEELEDRVFVNCNTTIYRASSLSNCRHTSSVEE

SEQ ID NO: 2414 - protein, 42 aa, Artificial Sequence; identical to SEQ ID NO: 1021
  chemically synthesized

SEQ ID NO: 2415 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTTIYRASSLSNCRHTSSVEE

SEQ ID NO: 2416 - protein, 42 aa, Artificial Sequence; identical to SEQ ID NO: 1141
  chemically synthesized

SEQ ID NO: 2417 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTTIYRASSLSNCRHTSSVEE

SEQ ID NO: 2418 - protein, 42 aa, Artificial Sequence
  chemically synthesized
SQVSPFKIPIEEVEDRVFVNCNTTIYRASSLSNCRHTSSVEE

SEQ ID NO: 2419 - protein, 42 aa, Artificial Sequence; identical to SEQ ID NO: 1258
  chemically synthesized

SEQ ID NO: 2420 - protein, 42 aa, Artificial Sequence
  chemically synthesized
SQVSPFKIPIEEFEDRVFVNCNTTIYRASSLSNCRHTSSVEE

SEQ ID NO: 2421 - protein, 42 aa, Artificial Sequence
  chemically synthesized
SQVSPFKIPIEEHEDRVFVNCNTTIYRASSLSNCRHTSSVEE

SEQ ID NO: 2422 - protein, 42 aa, Artificial Sequence
  chemically synthesized
SQVSPFKIPIEEMEDRVFVNCNTTIYRASSLSNCRHTSSVEE

SEQ ID NO: 2423 - protein, 42 aa, Artificial Sequence; identical to SEQ ID NO: 1378
  chemically synthesized

SEQ ID NO: 2424 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTTIYRASSLSNCRHTSSVEE

SEQ ID NO: 2425 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTTIYRASSLSNCRHTSSVEE

SEQ ID NO: 2426 - protein, 42 aa, Artificial Sequence
  chemically synthesized
SQVSPFKIPIEELEERVFVNCNTTIYRASSLSNCRHTSSVEE

SEQ ID NO: 2427 - protein, 42 aa, Artificial Sequence; identical to SEQ ID NO: 1497
  chemically synthesized

SEQ ID NO: 2428 - protein, 42 aa, Artificial Sequence
  chemically synthesized
SQVSPFKIPIEELEDHVFVNCNTTIYRASSLSNCRHTSSVEE

SEQ ID NO: 2429 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTTIYRASSLSNCRHTSSVEE

SEQ ID NO: 2430 - protein, 42 aa, Artificial Sequence; identical to SEQ ID NO: 1614
  chemically synthesized

SEQ ID NO: 2431 - protein, 42 aa, Artificial Sequence
  chemically synthesized
SQVSPFKIPIEELEDRLFVNCNTTIYRASSLSNCRHTSSVEE

SEQ ID NO: 2432 - protein, 42 aa, Artificial Sequence
  chemically synthesized
SQVSPFKIPIEELEDRFFVNCNTTIYRASSLSNCRHTSSVEE

SEQ ID NO: 2433 - protein, 42 aa, Artificial Sequence
  chemically synthesized
SQVSPFKIPIEELEDRHFVNCNTTIYRASSLSNCRHTSSVEE

SEQ ID NO: 2434 - protein, 42 aa, Artificial Sequence
  chemically synthesized
SQVSPFKIPIEELEDRMFVNCNTTIYRASSLSNCRHTSSVEE

SEQ ID NO: 2435 - protein, 42 aa, Artificial Sequence; identical to SEQ ID NO: 1731
  chemically synthesized

SEQ ID NO: 2436 - protein, 42 aa, Artificial Sequence
  chemically synthesized
SQVSPFKIPIEELEDRVLVNCNTTIYRASSLSNCRHTSSVEE

SEQ ID NO: 2437 - protein, 42 aa, Artificial Sequence
  chemically synthesized
SQVSPFKIPIEELEDRVVVNCNTTIYRASSLSNCRHTSSVEE

SEQ ID NO: 2438 - protein, 42 aa, Artificial Sequence
  chemically synthesized
SQVSPFKIPIEELEDRVHVNCNTTIYRASSLSNCRHTSSVEE

SEQ ID NO: 2439 - protein, 42 aa, Artificial Sequence
  chemically synthesized
SQVSPFKIPIEELEDRVMVNCNTTIYRASSLSNCRHTSSVEE

SEQ ID NO: 2440 - protein, 42 aa, Artificial Sequence; identical to SEQ ID NO: 1848
  chemically synthesized

SEQ ID NO: 2441 - protein, 42 aa, Artificial Sequence
  chemically synthesized
SQVSPFKIPIEELEDRVFLNCNTTIYRASSLSNCRHTSSVEE

SEQ ID NO: 2442 - protein, 42 aa, Artificial Sequence
  chemically synthesized
SQVSPFKIPIEELEDRVFFNCNTTIYRASSLSNCRHTSSVEE

SEQ ID NO: 2443 - protein, 42 aa, Artificial Sequence
  chemically synthesized
SQVSPFKIPIEELEDRVFHNCNTTIYRASSLSNCRHTSSVEE

SEQ ID NO: 2444 - protein, 42 aa, Artificial Sequence
  chemically synthesized
SQVSPFKIPIEELEDRVFMNCNTTIYRASSLSNCRHTSSVEE

SEQ ID NO: 2445 - protein, 42 aa, Artificial Sequence; identical to SEQ ID NO: 1969
  chemically synthesized

SEQ ID NO: 2446 - protein, 42 aa, Artificial Sequence
  chemically synthesized
SQVSPFKIPIEELEDRVFVNSNTTIYRASSLSNCRHTSSVEE

SEQ ID NO: 2447 - protein, 42 aa, Artificial Sequence
  chemically synthesized
SQVSPFKIPIEELEDRVFVNGNTTIYRASSLSNCRHTSSVEE

SEQ ID NO: 2448 - protein, 42 aa, Artificial Sequence
  chemically synthesized
SQVSPFKIPIEELEDRVFVNANTTIYRASSLSNCRHTSSVEE

SEQ ID NO: 2449 - protein, 42 aa, Artificial Sequence; identical to SEQ ID NO: 2210
  chemically synthesized

SEQ ID NO: 2450 - protein, 42 aa, Artificial Sequence; identical to SEQ ID NO: 2330
  chemically synthesized

SEQ ID NO: 2451 - protein, 42 aa, Artificial Sequence
  chemically synthesized
SQVSPFKIPIEELEDRVFVNCNYTIYRASSLSNCRHTSSVEE

SEQ ID NO: 2452 - protein, 42 aa, Artificial Sequence
  chemically synthesized
SQVSPFKIPIEELEDRVFVNCNTTVYRASSLSNCRHTSSVEE

SEQ ID NO: 2453 - protein, 42 aa, Artificial Sequence
  chemically synthesized
SQVSPFKIPIEELEDRVFVNCNTTLYRASSLSNCRHTSSVEE

SEQ ID NO: 2454 - protein, 42 aa, Artificial Sequence
  chemically synthesized
SQVSPFKIPIEELEDRVFVNCNTTHYRASSLSNCRHTSSVEE

SEQ ID NO: 2455 - protein, 42 aa, Artificial Sequence
  chemically synthesized
SQVSPFKIPIEELEDRVFVNCNTTFYRASSLSNCRHTSSVEE

SEQ ID NO: 2456 - protein, 42 aa, Artificial Sequence
  chemically synthesized
SQVSPFKIPIEELEDRVFVNCNTTMYRASSLSNCRHTSSVEE

SEQ ID NO: 2457 - protein, 42 aa, Artificial Sequence
  chemically synthesized
SQVSPFKIPIEELEDRVFVNCNTTIWRASSLSNCRHTSSVEE

SEQ ID NO: 2458 - protein, 42 aa, Artificial Sequence
  chemically synthesized
SQVSPFKIPIEELEDRVFVNCNTTIFRASSLSNCRHTSSVEE

SEQ ID NO: 2459 - protein, 42 aa, Artificial Sequence
  chemically synthesized
SQVSPFKIPIEELEDRVFVNCNTTISRASSLSNCRHTSSVEE

SEQ ID NO: 2460 - protein, 42 aa, Artificial Sequence
  chemically synthesized
SQVSPFKIPIEELEDRVFVNCNTTITRASSLSNCRHTSSVEE

SEQ ID NO: 2461 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTTIYXASSLSNCRHTSSVEE

SEQ ID NO: 2462 - protein, 42 aa, Artificial Sequence
  chemically synthesized
SQVSPFKIPIEELEDRVFVNCNTTIYHASSLSNCRHTSSVEE

SEQ ID NO: 2463 - protein, 42 aa, Artificial Sequence
  chemically synthesized
SQVSPFKIPIEELEDRVFVNCNTTIYKASSLSNCRHTSSVEE

SEQ ID NO: 2464 - protein, 42 aa, Artificial Sequence
  chemically synthesized
SQVSPFKIPIEELEDRVFVNCNTTIYRGSSLSNCRHTSSVEE

SEQ ID NO: 2465 - protein, 42 aa, Artificial Sequence
  chemically synthesized
SQVSPFKIPIEELEDRVFVNCNTTIYRATSLSNCRHTSSVEE

SEQ ID NO: 2466 - protein, 42 aa, Artificial Sequence
  chemically synthesized
SQVSPFKIPIEELEDRVFVNCNTTIYRAYSLSNCRHTSSVEE

SEQ ID NO: 2467 - protein, 42 aa, Artificial Sequence
  chemically synthesized
SQVSPFKIPIEELEDRVFVNCNTTIYRASTLSNCRHTSSVEE

SEQ ID NO: 2468 - protein, 42 aa, Artificial Sequence
  chemically synthesized
SQVSPFKIPIEELEDRVFVNCNTTIYRASYLSNCRHTSSVEE

SEQ ID NO: 2469 - protein, 42 aa, Artificial Sequence
  chemically synthesized
SQVSPFKIPIEELEDRVFVNCNTTIYRASSISNCRHTSSVEE

SEQ ID NO: 2470 - protein, 42 aa, Artificial Sequence
  chemically synthesized
SQVSPFKIPIEELEDRVFVNCNTTIYRASSVSNCRHTSSVEE

SEQ ID NO: 2471 - protein, 42 aa, Artificial Sequence
  chemically synthesized
SQVSPFKIPIEELEDRVFVNCNTTIYRASSFSNCRHTSSVEE

SEQ ID NO: 2472 - protein, 42 aa, Artificial Sequence
  chemically synthesized
SQVSPFKIPIEELEDRVFVNCNTTIYRASSMSNCRHTSSVEE

SEQ ID NO: 2473 - protein, 42 aa, Artificial Sequence
  chemically synthesized
SQVSPFKIPIEELEDRVFVNCNTTIYRASSHSNCRHTSSVEE

SEQ ID NO: 2474 - protein, 42 aa, Artificial Sequence
  chemically synthesized
SQVSPFKIPIEELEDRVFVNCNTTIYRASSLTNCRHTSSVEE

SEQ ID NO: 2475 - protein, 42 aa, Artificial Sequence
  chemically synthesized
SQVSPFKIPIEELEDRVFVNCNTTIYRASSLYNCRHTSSVEE

SEQ ID NO: 2476 - protein, 42 aa, Artificial Sequence
  chemically synthesized
SQVSPFKIPIEELEDRVFVNCNTTIYRASSLSQCRHTSSVEE

SEQ ID NO: 2477 - protein, 42 aa, Artificial Sequence
  chemically synthesized
SQVSPFKIPIEELEDRVFVNCNTTIYRASSLSNSRHTSSVEE

SEQ ID NO: 2478 - protein, 42 aa, Artificial Sequence
  chemically synthesized
SQVSPFKIPIEELEDRVFVNCNTTIYRASSLSNGRHTSSVEE

SEQ ID NO: 2479 - protein, 42 aa, Artificial Sequence
  chemically synthesized
SQVSPFKIPIEELEDRVFVNCNTTIYRASSLSNARHTSSVEE

SEQ ID NO: 2480 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTTIYRASSLSNCXHTSSVEE

SEQ ID NO: 2481 - protein, 42 aa, Artificial Sequence
  chemically synthesized
SQVSPFKIPIEELEDRVFVNCNTTIYRASSLSNCHHTSSVEE

SEQ ID NO: 2482 - protein, 42 aa, Artificial Sequence
  chemically synthesized
SQVSPFKIPIEELEDRVFVNCNTTIYRASSLSNCKHTSSVEE

SEQ ID NO: 2483 - protein, 42 aa, Artificial Sequence
  chemically synthesized
SQVSPFKIPIEELEDRVFVNCNTTIYRASSLSNCRGTSSVEE

SEQ ID NO: 2484 - protein, 42 aa, Artificial Sequence
  chemically synthesized
SQVSPFKIPIEELEDRVFVNCNTTIYRASSLSNCRATSSVEE

SEQ ID NO: 2485 - protein, 42 aa, Artificial Sequence
  chemically synthesized
SQVSPFKIPIEELEDRVFVNCNTTIYRASSLSNCRITSSVEE

SEQ ID NO: 2486 - protein, 42 aa, Artificial Sequence
  chemically synthesized
SQVSPFKIPIEELEDRVFVNCNTTIYRASSLSNCRLTSSVEE

SEQ ID NO: 2487 - protein, 42 aa, Artificial Sequence
  chemically synthesized
SQVSPFKIPIEELEDRVFVNCNTTIYRASSLSNCRMTSSVEE

SEQ ID NO: 2488 - protein, 42 aa, Artificial Sequence
  chemically synthesized
SQVSPFKIPIEELEDRVFVNCNTTIYRASSLSNCRVTSSVEE

SEQ ID NO: 2489 - protein, 42 aa, Artificial Sequence
  chemically synthesized
SQVSPFKIPIEELEDRVFVNCNTTIYRASSLSNCRHSSSVEE

SEQ ID NO: 2490 - protein, 42 aa, Artificial Sequence
  chemically synthesized
SQVSPFKIPIEELEDRVFVNCNTTIYRASSLSNCRHYSSVEE

SEQ ID NO: 2491 - protein, 42 aa, Artificial Sequence
  chemically synthesized
SQVSPFKIPIEELEDRVFVNCNTTIYRASSLSNCRHTTSVEE

SEQ ID NO: 2492 - protein, 42 aa, Artificial Sequence
  chemically synthesized
SQVSPFKIPIEELEDRVFVNCNTTIYRASSLSNCRHTYSVEE

SEQ ID NO: 2493 - protein, 42 aa, Artificial Sequence
  chemically synthesized
SQVSPFKIPIEELEDRVFVNCNTTIYRASSLSNCRHTSTVEE

SEQ ID NO: 2494 - protein, 42 aa, Artificial Sequence
  chemically synthesized
SQVSPFKIPIEELEDRVFVNCNTTIYRASSLSNCRHTSYVEE

SEQ ID NO: 2495 - protein, 42 aa, Artificial Sequence
  chemically synthesized
SQVSPFKIPIEELEDRVFVNCNTTIYRASSLSNCRHTSSIEE

SEQ ID NO: 2496 - protein, 42 aa, Artificial Sequence
  chemically synthesized
SQVSPFKIPIEELEDRVFVNCNTTIYRASSLSNCRHTSSLEE

SEQ ID NO: 2497 - protein, 42 aa, Artificial Sequence
  chemically synthesized
SQVSPFKIPIEELEDRVFVNCNTTIYRASSLSNCRHTSSFEE

SEQ ID NO: 2498 - protein, 42 aa, Artificial Sequence
  chemically synthesized
SQVSPFKIPIEELEDRVFVNCNTTIYRASSLSNCRHTSSHEE

SEQ ID NO: 2499 - protein, 42 aa, Artificial Sequence
  chemically synthesized
SQVSPFKIPIEELEDRVFVNCNTTIYRASSLSNCRHTSSMEE

SEQ ID NO: 2500 - protein, 42 aa, Artificial Sequence
  chemically synthesized
SQVSPFKIPIEELEDRVFVNCNTTIYRASSLSNCRHTSSVDE

SEQ ID NO: 2501 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTTIYRASSLSNCRHTSSVXE

SEQ ID NO: 2502 - protein, 42 aa, Artificial Sequence
  chemically synthesized
SQVSPFKIPIEELEDRVFVNCNTTIYRASSLSNCRHTSSVED

SEQ ID NO: 2503 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTTIYRASSLSNCRHTSSVEX

SEQ ID NO: 2504 - protein, 42 aa, Artificial Sequence
  chemically synthesized
SQVSAFKIPIEELEDRVFVNCNTTIYRASSLSNCRHTSSVEE

SEQ ID NO: 2505 - protein, 42 aa, Artificial Sequence
  chemically synthesized
SQVSGFKIPIEELEDRVFVNCNTTIYRASSLSNCRHTSSVEE

SEQ ID NO: 2506 - protein, 42 aa, Artificial Sequence
  chemically synthesized
SQVSPFKIAIEELEDRVFVNCNTTIYRASSLSNCRHTSSVEE

SEQ ID NO: 2507 - protein, 42 aa, Artificial Sequence
  chemically synthesized
SQVSPFKIGIEELEDRVFVNCNTTIYRASSLSNCRHTSSVEE

SEQ ID NO: 2508 - protein, 42 aa, Artificial Sequence; identical to SEQ ID NO: 71
  chemically synthesized

SEQ ID NO: 2509 - protein, 42 aa, Artificial Sequence; identical to SEQ ID NO: 190
  chemically synthesized

SEQ ID NO: 2510 - protein, 42 aa, Artificial Sequence
  chemically synthesized
YQVSPFKIPIEELEDRVFVNCNTSLYRASSLSNCRHTSSVEE

SEQ ID NO: 2511 - protein, 42 aa, Artificial Sequence; identical to SEQ ID NO: 310
  chemically synthesized

SEQ ID NO: 2512 - protein, 42 aa, Artificial Sequence; identical to SEQ ID NO: 428
  chemically synthesized

SEQ ID NO: 2513 - protein, 42 aa, Artificial Sequence
  chemically synthesized
SQISPFKIPIEELEDRVFVNCNTSLYRASSLSNCRHTSSVEE

SEQ ID NO: 2514 - protein, 42 aa, Artificial Sequence
  chemically synthesized
SQPSPFKIPIEELEDRVFVNCNTSLYRASSLSNCRHTSSVEE

SEQ ID NO: 2515 - protein, 42 aa, Artificial Sequence
  chemically synthesized
SQFSPFKIPIEELEDRVFVNCNTSLYRASSLSNCRHTSSVEE

SEQ ID NO: 2516 - protein, 42 aa, Artificial Sequence; identical to SEQ ID NO: 547
  chemically synthesized

SEQ ID NO: 2517 - protein, 42 aa, Artificial Sequence
  chemically synthesized
SQVYPFKIPIEELEDRVFVNCNTSLYRASSLSNCRHTSSVEE

SEQ ID NO: 2518 - protein, 42 aa, Artificial Sequence
  chemically synthesized
SQVSPWKIPIEELEDRVFVNCNTSLYRASSLSNCRHTSSVEE

SEQ ID NO: 2519 - protein, 42 aa, Artificial Sequence
  chemically synthesized
SQVSPYKIPIEELEDRVFVNCNTSLYRASSLSNCRHTSSVEE

SEQ ID NO: 2520 - protein, 42 aa, Artificial Sequence
  chemically synthesized
SQVSPHKIPIEELEDRVFVNCNTSLYRASSLSNCRHTSSVEE

SEQ ID NO: 2521 - protein, 42 aa, Artificial Sequence
  chemically synthesized
SQVSPFRIPIEELEDRVFVNCNTSLYRASSLSNCRHTSSVEE

SEQ ID NO: 2522 - protein, 42 aa, Artificial Sequence
  chemically synthesized
SQVSPFHIPIEELEDRVFVNCNTSLYRASSLSNCRHTSSVEE

SEQ ID NO: 2523 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSLYRASSLSNCRHTSSVEE

SEQ ID NO: 2524 - protein, 42 aa, Artificial Sequence; identical to SEQ ID NO: 786
  chemically synthesized

SEQ ID NO: 2525 - protein, 42 aa, Artificial Sequence
  chemically synthesized
SQVSPFKHPIEELEDRVFVNCNTSLYRASSLSNCRHTSSVEE

SEQ ID NO: 2526 - protein, 42 aa, Artificial Sequence
  chemically synthesized
SQVSPFKVPIEELEDRVFVNCNTSLYRASSLSNCRHTSSVEE

SEQ ID NO: 2527 - protein, 42 aa, Artificial Sequence
  chemically synthesized
SQVSPFKFPIEELEDRVFVNCNTSLYRASSLSNCRHTSSVEE

SEQ ID NO: 2528 - protein, 42 aa, Artificial Sequence
  chemically synthesized
SQVSPFKMPIEELEDRVFVNCNTSLYRASSLSNCRHTSSVEE

SEQ ID NO: 2529 - protein, 42 aa, Artificial Sequence; identical to SEQ ID NO: 904
  chemically synthesized

SEQ ID NO: 2530 - protein, 42 aa, Artificial Sequence
  chemically synthesized
SQVSPFKIPHEELEDRVFVNCNTSLYRASSLSNCRHTSSVEE

SEQ ID NO: 2531 - protein, 42 aa, Artificial Sequence
  chemically synthesized
SQVSPFKIPVEELEDRVFVNCNTSLYRASSLSNCRHTSSVEE

SEQ ID NO: 2532 - protein, 42 aa, Artificial Sequence
  chemically synthesized
SQVSPFKIPFEELEDRVFVNCNTSLYRASSLSNCRHTSSVEE

SEQ ID NO: 2533 - protein, 42 aa, Artificial Sequence
  chemically synthesized
SQVSPFKIPMEELEDRVFVNCNTSLYRASSLSNCRHTSSVEE

SEQ ID NO: 2534 - protein, 42 aa, Artificial Sequence; identical to SEQ ID NO: 1024
  chemically synthesized

SEQ ID NO: 2535 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSLYRASSLSNCRHTSSVEE

SEQ ID NO: 2536 - protein, 42 aa, Artificial Sequence; identical to SEQ ID NO: 1144
  chemically synthesized

SEQ ID NO: 2537 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSLYRASSLSNCRHTSSVEE

SEQ ID NO: 2538 - protein, 42 aa, Artificial Sequence
  chemically synthesized
SQVSPFKIPIEEVEDRVFVNCNTSLYRASSLSNCRHTSSVEE

SEQ ID NO: 2539 - protein, 42 aa, Artificial Sequence; identical to SEQ ID NO: 1261
  chemically synthesized

SEQ ID NO: 2540 - protein, 42 aa, Artificial Sequence
  chemically synthesized
SQVSPFKIPIEEFEDRVFVNCNTSLYRASSLSNCRHTSSVEE

SEQ ID NO: 2541 - protein, 42 aa, Artificial Sequence
  chemically synthesized
SQVSPFKIPIEEHEDRVFVNCNTSLYRASSLSNCRHTSSVEE

SEQ ID NO: 2542 - protein, 42 aa, Artificial Sequence
  chemically synthesized
SQVSPFKIPIEEMEDRVFVNCNTSLYRASSLSNCRHTSSVEE

SEQ ID NO: 2543 - protein, 42 aa, Artificial Sequence; identical to SEQ ID NO: 1381
  chemically synthesized

SEQ ID NO: 2544 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSLYRASSLSNCRHTSSVEE

SEQ ID NO: 2545 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSLYRASSLSNCRHTSSVEE

SEQ ID NO: 2546 - protein, 42 aa, Artificial Sequence
  chemically synthesized
SQVSPFKIPIEELEERVFVNCNTSLYRASSLSNCRHTSSVEE

SEQ ID NO: 2547 - protein, 42 aa, Artificial Sequence; identical to SEQ ID NO: 1500
  chemically synthesized

SEQ ID NO: 2548 - protein, 42 aa, Artificial Sequence
  chemically synthesized
SQVSPFKIPIEELEDHVFVNCNTSLYRASSLSNCRHTSSVEE

SEQ ID NO: 2549 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSLYRASSLSNCRHTSSVEE

SEQ ID NO: 2550 - protein, 42 aa, Artificial Sequence; identical to SEQ ID NO: 1617
  chemically synthesized

SEQ ID NO: 2551 - protein, 42 aa, Artificial Sequence
  chemically synthesized
SQVSPFKIPIEELEDRLFVNCNTSLYRASSLSNCRHTSSVEE

SEQ ID NO: 2552 - protein, 42 aa, Artificial Sequence
  chemically synthesized
SQVSPFKIPIEELEDRFFVNCNTSLYRASSLSNCRHTSSVEE

SEQ ID NO: 2553 - protein, 42 aa, Artificial Sequence
  chemically synthesized
SQVSPFKIPIEELEDRHFVNCNTSLYRASSLSNCRHTSSVEE

SEQ ID NO: 2554 - protein, 42 aa, Artificial Sequence
  chemically synthesized
SQVSPFKIPIEELEDRMFVNCNTSLYRASSLSNCRHTSSVEE

SEQ ID NO: 2555 - protein, 42 aa, Artificial Sequence; identical to SEQ ID NO: 1734
  chemically synthesized

SEQ ID NO: 2556 - protein, 42 aa, Artificial Sequence
  chemically synthesized
SQVSPFKIPIEELEDRVLVNCNTSLYRASSLSNCRHTSSVEE

SEQ ID NO: 2557 - protein, 42 aa, Artificial Sequence
  chemically synthesized
SQVSPFKIPIEELEDRVVVNCNTSLYRASSLSNCRHTSSVEE

SEQ ID NO: 2558 - protein, 42 aa, Artificial Sequence
  chemically synthesized
SQVSPFKIPIEELEDRVHVNCNTSLYRASSLSNCRHTSSVEE

SEQ ID NO: 2559 - protein, 42 aa, Artificial Sequence
  chemically synthesized
SQVSPFKIPIEELEDRVMVNCNTSLYRASSLSNCRHTSSVEE

SEQ ID NO: 2560 - protein, 42 aa, Artificial Sequence; identical to SEQ ID NO: 1851
  chemically synthesized

SEQ ID NO: 2561 - protein, 42 aa, Artificial Sequence
  chemically synthesized
SQVSPFKIPIEELEDRVFLNCNTSLYRASSLSNCRHTSSVEE

SEQ ID NO: 2562 - protein, 42 aa, Artificial Sequence
  chemically synthesized
SQVSPFKIPIEELEDRVFFNCNTSLYRASSLSNCRHTSSVEE

SEQ ID NO: 2563 - protein, 42 aa, Artificial Sequence
  chemically synthesized
SQVSPFKIPIEELEDRVFHNCNTSLYRASSLSNCRHTSSVEE

SEQ ID NO: 2564 - protein, 42 aa, Artificial Sequence
  chemically synthesized
SQVSPFKIPIEELEDRVFMNCNTSLYRASSLSNCRHTSSVEE

SEQ ID NO: 2565 - protein, 42 aa, Artificial Sequence; identical to SEQ ID NO: 1972
  chemically synthesized

SEQ ID NO: 2566 - protein, 42 aa, Artificial Sequence
  chemically synthesized
SQVSPFKIPIEELEDRVFVNSNTSLYRASSLSNCRHTSSVEE

SEQ ID NO: 2567 - protein, 42 aa, Artificial Sequence
  chemically synthesized
SQVSPFKIPIEELEDRVFVNGNTSLYRASSLSNCRHTSSVEE

SEQ ID NO: 2568 - protein, 42 aa, Artificial Sequence
  chemically synthesized
SQVSPFKIPIEELEDRVFVNANTSLYRASSLSNCRHTSSVEE

SEQ ID NO: 2569 - protein, 42 aa, Artificial Sequence; identical to SEQ ID NO: 2213
  chemically synthesized

SEQ ID NO: 2570 - protein, 42 aa, Artificial Sequence; identical to SEQ ID NO: 2333
  chemically synthesized

SEQ ID NO: 2571 - protein, 42 aa, Artificial Sequence
  chemically synthesized
SQVSPFKIPIEELEDRVFVNCNYSLYRASSLSNCRHTSSVEE

SEQ ID NO: 2572 - protein, 42 aa, Artificial Sequence; identical to SEQ ID NO: 2453
  chemically synthesized

SEQ ID NO: 2573 - protein, 42 aa, Artificial Sequence
  chemically synthesized
SQVSPFKIPIEELEDRVFVNCNTYLYRASSLSNCRHTSSVEE

SEQ ID NO: 2574 - protein, 42 aa, Artificial Sequence
  chemically synthesized
SQVSPFKIPIEELEDRVFVNCNTSLWRASSLSNCRHTSSVEE

SEQ ID NO: 2575 - protein, 42 aa, Artificial Sequence
  chemically synthesized
SQVSPFKIPIEELEDRVFVNCNTSLFRASSLSNCRHTSSVEE

SEQ ID NO: 2576 - protein, 42 aa, Artificial Sequence
  chemically synthesized
SQVSPFKIPIEELEDRVFVNCNTSLSRASSLSNCRHTSSVEE

SEQ ID NO: 2577 - protein, 42 aa, Artificial Sequence
  chemically synthesized
SQVSPFKIPIEELEDRVFVNCNTSLTRASSLSNCRHTSSVEE

SEQ ID NO: 2578 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSLYXASSLSNCRHTSSVEE

SEQ ID NO: 2579 - protein, 42 aa, Artificial Sequence
  chemically synthesized
SQVSPFKIPIEELEDRVFVNCNTSLYHASSLSNCRHTSSVEE

SEQ ID NO: 2580 - protein, 42 aa, Artificial Sequence
  chemically synthesized
SQVSPFKIPIEELEDRVFVNCNTSLYKASSLSNCRHTSSVEE

SEQ ID NO: 2581 - protein, 42 aa, Artificial Sequence
  chemically synthesized
SQVSPFKIPIEELEDRVFVNCNTSLYRGSSLSNCRHTSSVEE

SEQ ID NO: 2582 - protein, 42 aa, Artificial Sequence
  chemically synthesized
SQVSPFKIPIEELEDRVFVNCNTSLYRATSLSNCRHTSSVEE

SEQ ID NO: 2583 - protein, 42 aa, Artificial Sequence
  chemically synthesized
SQVSPFKIPIEELEDRVFVNCNTSLYRAYSLSNCRHTSSVEE

SEQ ID NO: 2584 - protein, 42 aa, Artificial Sequence
  chemically synthesized
SQVSPFKIPIEELEDRVFVNCNTSLYRASTLSNCRHTSSVEE

SEQ ID NO: 2585 - protein, 42 aa, Artificial Sequence
  chemically synthesized
SQVSPFKIPIEELEDRVFVNCNTSLYRASYLSNCRHTSSVEE

SEQ ID NO: 2586 - protein, 42 aa, Artificial Sequence
  chemically synthesized
SQVSPFKIPIEELEDRVFVNCNTSLYRASSISNCRHTSSVEE

SEQ ID NO: 2587 - protein, 42 aa, Artificial Sequence
  chemically synthesized
SQVSPFKIPIEELEDRVFVNCNTSLYRASSVSNCRHTSSVEE

SEQ ID NO: 2588 - protein, 42 aa, Artificial Sequence
  chemically synthesized
SQVSPFKIPIEELEDRVFVNCNTSLYRASSFSNCRHTSSVEE

SEQ ID NO: 2589 - protein, 42 aa, Artificial Sequence
  chemically synthesized
SQVSPFKIPIEELEDRVFVNCNTSLYRASSMSNCRHTSSVEE

SEQ ID NO: 2590 - protein, 42 aa, Artificial Sequence
  chemically synthesized
SQVSPFKIPIEELEDRVFVNCNTSLYRASSHSNCRHTSSVEE

SEQ ID NO: 2591 - protein, 42 aa, Artificial Sequence
  chemically synthesized
SQVSPFKIPIEELEDRVFVNCNTSLYRASSLTNCRHTSSVEE

SEQ ID NO: 2592 - protein, 42 aa, Artificial Sequence
  chemically synthesized
SQVSPFKIPIEELEDRVFVNCNTSLYRASSLYNCRHTSSVEE

SEQ ID NO: 2593 - protein, 42 aa, Artificial Sequence
  chemically synthesized
SQVSPFKIPIEELEDRVFVNCNTSLYRASSLSQCRHTSSVEE

SEQ ID NO: 2594 - protein, 42 aa, Artificial Sequence
  chemically synthesized
SQVSPFKIPIEELEDRVFVNCNTSLYRASSLSNSRHTSSVEE

SEQ ID NO: 2595 - protein, 42 aa, Artificial Sequence
  chemically synthesized
SQVSPFKIPIEELEDRVFVNCNTSLYRASSLSNGRHTSSVEE

SEQ ID NO: 2596 - protein, 42 aa, Artificial Sequence
  chemically synthesized
SQVSPFKIPIEELEDRVFVNCNTSLYRASSLSNARHTSSVEE

SEQ ID NO: 2597 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSLYRASSLSNCXHTSSVEE

SEQ ID NO: 2598 - protein, 42 aa, Artificial Sequence
  chemically synthesized
SQVSPFKIPIEELEDRVFVNCNTSLYRASSLSNCHHTSSVEE

SEQ ID NO: 2599 - protein, 42 aa, Artificial Sequence
  chemically synthesized
SQVSPFKIPIEELEDRVFVNCNTSLYRASSLSNCKHTSSVEE

SEQ ID NO: 2600 - protein, 42 aa, Artificial Sequence
  chemically synthesized
SQVSPFKIPIEELEDRVFVNCNTSLYRASSLSNCRGTSSVEE

SEQ ID NO: 2601 - protein, 42 aa, Artificial Sequence
  chemically synthesized
SQVSPFKIPIEELEDRVFVNCNTSLYRASSLSNCRATSSVEE

SEQ ID NO: 2602 - protein, 42 aa, Artificial Sequence
  chemically synthesized
SQVSPFKIPIEELEDRVFVNCNTSLYRASSLSNCRITSSVEE

SEQ ID NO: 2603 - protein, 42 aa, Artificial Sequence
  chemically synthesized
SQVSPFKIPIEELEDRVFVNCNTSLYRASSLSNCRLTSSVEE

SEQ ID NO: 2604 - protein, 42 aa, Artificial Sequence
  chemically synthesized
SQVSPFKIPIEELEDRVFVNCNTSLYRASSLSNCRMTSSVEE

SEQ ID NO: 2605 - protein, 42 aa, Artificial Sequence
  chemically synthesized
SQVSPFKIPIEELEDRVFVNCNTSLYRASSLSNCRVTSSVEE

SEQ ID NO: 2606 - protein, 42 aa, Artificial Sequence
  chemically synthesized
SQVSPFKIPIEELEDRVFVNCNTSLYRASSLSNCRHSSSVEE

SEQ ID NO: 2607 - protein, 42 aa, Artificial Sequence
  chemically synthesized
SQVSPFKIPIEELEDRVFVNCNTSLYRASSLSNCRHYSSVEE

SEQ ID NO: 2608 - protein, 42 aa, Artificial Sequence
  chemically synthesized
SQVSPFKIPIEELEDRVFVNCNTSLYRASSLSNCRHTTSVEE

SEQ ID NO: 2609 - protein, 42 aa, Artificial Sequence
  chemically synthesized
SQVSPFKIPIEELEDRVFVNCNTSLYRASSLSNCRHTYSVEE

SEQ ID NO: 2610 - protein, 42 aa, Artificial Sequence
  chemically synthesized
SQVSPFKIPIEELEDRVFVNCNTSLYRASSLSNCRHTSTVEE

SEQ ID NO: 2611 - protein, 42 aa, Artificial Sequence
  chemically synthesized
SQVSPFKIPIEELEDRVFVNCNTSLYRASSLSNCRHTSYVEE

SEQ ID NO: 2612 - protein, 42 aa, Artificial Sequence
  chemically synthesized
SQVSPFKIPIEELEDRVFVNCNTSLYRASSLSNCRHTSSIEE

SEQ ID NO: 2613 - protein, 42 aa, Artificial Sequence
  chemically synthesized
SQVSPFKIPIEELEDRVFVNCNTSLYRASSLSNCRHTSSLEE

SEQ ID NO: 2614 - protein, 42 aa, Artificial Sequence
  chemically synthesized
SQVSPFKIPIEELEDRVFVNCNTSLYRASSLSNCRHTSSFEE

SEQ ID NO: 2615 - protein, 42 aa, Artificial Sequence
  chemically synthesized
SQVSPFKIPIEELEDRVFVNCNTSLYRASSLSNCRHTSSHEE

SEQ ID NO: 2616 - protein, 42 aa, Artificial Sequence
  chemically synthesized
SQVSPFKIPIEELEDRVFVNCNTSLYRASSLSNCRHTSSMEE

SEQ ID NO: 2617 - protein, 42 aa, Artificial Sequence
  chemically synthesized
SQVSPFKIPIEELEDRVFVNCNTSLYRASSLSNCRHTSSVDE

SEQ ID NO: 2618 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSLYRASSLSNCRHTSSVXE

SEQ ID NO: 2619 - protein, 42 aa, Artificial Sequence
  chemically synthesized
SQVSPFKIPIEELEDRVFVNCNTSLYRASSLSNCRHTSSVED

SEQ ID NO: 2620 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSLYRASSLSNCRHTSSVEX

SEQ ID NO: 2621 - protein, 42 aa, Artificial Sequence
  chemically synthesized
SQVSAFKIPIEELEDRVFVNCNTSLYRASSLSNCRHTSSVEE

SEQ ID NO: 2622 - protein, 42 aa, Artificial Sequence
  chemically synthesized
SQVSGFKIPIEELEDRVFVNCNTSLYRASSLSNCRHTSSVEE

SEQ ID NO: 2623 - protein, 42 aa, Artificial Sequence
  chemically synthesized
SQVSPFKIAIEELEDRVFVNCNTSLYRASSLSNCRHTSSVEE

SEQ ID NO: 2624 - protein, 42 aa, Artificial Sequence
  chemically synthesized
SQVSPFKIGIEELEDRVFVNCNTSLYRASSLSNCRHTSSVEE

SEQ ID NO: 2625 - protein, 42 aa, Artificial Sequence; identical to SEQ ID NO: 78
  chemically synthesized

SEQ ID NO: 2626 - protein, 42 aa, Artificial Sequence; identical to SEQ ID NO: 197
  chemically synthesized

SEQ ID NO: 2627 - protein, 42 aa, Artificial Sequence; identical to SEQ ID NO: 197
  chemically synthesized

SEQ ID NO: 2628 - protein, 42 aa, Artificial Sequence; identical to SEQ ID NO: 317
  chemically synthesized

SEQ ID NO: 2629 - protein, 42 aa, Artificial Sequence; identical to SEQ ID NO: 435
  chemically synthesized

SEQ ID NO: 2630 - protein, 42 aa, Artificial Sequence
  chemically synthesized
SQISPFKIPIEELEDRVFVNCNTSITRASSLSNCRHTSSVEE

SEQ ID NO: 2631 - protein, 42 aa, Artificial Sequence
  chemically synthesized
SQPSPFKIPIEELEDRVFVNCNTSITRASSLSNCRHTSSVEE

SEQ ID NO: 2632 - protein, 42 aa, Artificial Sequence
  chemically synthesized
SQFSPFKIPIEELEDRVFVNCNTSITRASSLSNCRHTSSVEE

SEQ ID NO: 2633 - protein, 42 aa, Artificial Sequence; identical to SEQ ID NO: 554
  chemically synthesized

SEQ ID NO: 2634 - protein, 42 aa, Artificial Sequence
  chemically synthesized
SQVYPFKIPIEELEDRVFVNCNTSITRASSLSNCRHTSSVEE

SEQ ID NO: 2635 - protein, 42 aa, Artificial Sequence
  chemically synthesized
SQVSPWKIPIEELEDRVFVNCNTSITRASSLSNCRHTSSVEE

SEQ ID NO: 2636 - protein, 42 aa, Artificial Sequence
  chemically synthesized
SQVSPTKIPIEELEDRVFVNCNTSITRASSLSNCRHTSSVEE

SEQ ID NO: 2637 - protein, 42 aa, Artificial Sequence
  chemically synthesized
SQVSPHKIPIEELEDRVFVNCNTSITRASSLSNCRHTSSVEE

SEQ ID NO: 2638 - protein, 42 aa, Artificial Sequence
  chemically synthesized
SQVSPFRIPIEELEDRVFVNCNTSITRASSLSNCRHTSSVEE

SEQ ID NO: 2639 - protein, 42 aa, Artificial Sequence
  chemically synthesized
SQVSPFHIPIEELEDRVFVNCNTSITRASSLSNCRHTSSVEE

SEQ ID NO: 2640 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSITRASSLSNCRHTSSVEE

SEQ ID NO: 2641 - protein, 42 aa, Artificial Sequence; identical to SEQ ID NO: 793
  chemically synthesized

SEQ ID NO: 2642 - protein, 42 aa, Artificial Sequence
  chemically synthesized
SQVSPFKHPIEELEDRVFVNCNTSITRASSLSNCRHTSSVEE

SEQ ID NO: 2643 - protein, 42 aa, Artificial Sequence
  chemically synthesized
SQVSPFKVPIEELEDRVFVNCNTSITRASSLSNCRHTSSVEE

SEQ ID NO: 2644 - protein, 42 aa, Artificial Sequence
  chemically synthesized
SQVSPFKFPIEELEDRVFVNCNTSITRASSLSNCRHTSSVEE

SEQ ID NO: 2645 - protein, 42 aa, Artificial Sequence
  chemically synthesized
SQVSPFKMPIEELEDRVFVNCNTSITRASSLSNCRHTSSVEE

SEQ ID NO: 2646 - protein, 42 aa, Artificial Sequence; identical to SEQ ID NO: 911
  chemically synthesized

SEQ ID NO: 2647 - protein, 42 aa, Artificial Sequence
  chemically synthesized
SQVSPFKIPHEELEDRVFVNCNTSITRASSLSNCRHTSSVEE

SEQ ID NO: 2648 - protein, 42 aa, Artificial Sequence
  chemically synthesized
SQVSPFKIPVEELEDRVFVNCNTSITRASSLSNCRHTSSVEE

SEQ ID NO: 2649 - protein, 42 aa, Artificial Sequence
  chemically synthesized
SQVSPFKIPFEELEDRVFVNCNTSITRASSLSNCRHTSSVEE

SEQ ID NO: 2650 - protein, 42 aa, Artificial Sequence
  chemically synthesized
SQVSPFKIPMEELEDRVFVNCNTSITRASSLSNCRHTSSVEE

SEQ ID NO: 2651 - protein, 42 aa, Artificial Sequence; identical to SEQ ID NO: 1031
  chemically synthesized

SEQ ID NO: 2652 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSITRASSLSNCRHTSSVEE

SEQ ID NO: 2653 - protein, 42 aa, Artificial Sequence; identical to SEQ ID NO: 1151
  chemically synthesized

SEQ ID NO: 2654 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSITRASSLSNCRHTSSVEE

SEQ ID NO: 2655 - protein, 42 aa, Artificial Sequence
  chemically synthesized
SQVSPFKIPIEEVEDRVFVNCNTSITRASSLSNCRHTSSVEE

SEQ ID NO: 2656 - protein, 42 aa, Artificial Sequence; identical to SEQ ID NO: 1268
  chemically synthesized

SEQ ID NO: 2657 - protein, 42 aa, Artificial Sequence
  chemically synthesized
SQVSPFKIPIEEFEDRVFVNCNTSITRASSLSNCRHTSSVEE

SEQ ID NO: 2658 - protein, 42 aa, Artificial Sequence
  chemically synthesized
SQVSPFKIPIEEHEDRVFVNCNTSITRASSLSNCRHTSSVEE

SEQ ID NO: 2659 - protein, 42 aa, Artificial Sequence
  chemically synthesized
SQVSPFKIPIEEMEDRVFVNCNTSITRASSLSNCRHTSSVEE

SEQ ID NO: 2660 - protein, 42 aa, Artificial Sequence; identical to SEQ ID NO: 1388
  chemically synthesized

SEQ ID NO: 2661 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSITRASSLSNCRHTSSVEE

SEQ ID NO: 2662 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSITRASSLSNCRHTSSVEE

SEQ ID NO: 2663 - protein, 42 aa, Artificial Sequence
  chemically synthesized
SQVSPFKIPIEELEERVFVNCNTSITRASSLSNCRHTSSVEE

SEQ ID NO: 2664 - protein, 42 aa, Artificial Sequence; identical to SEQ ID NO: 1507
  chemically synthesized

SEQ ID NO: 2665 - protein, 42 aa, Artificial Sequence
  chemically synthesized
SQVSPFKIPIEELEDHVFVNCNTSITRASSLSNCRHTSSVEE

SEQ ID NO: 2666 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSITRASSLSNCRHTSSVEE

SEQ ID NO: 2667 - protein, 42 aa, Artificial Sequence; identical to SEQ ID NO: 1624
  chemically synthesized

SEQ ID NO: 2668 - protein, 42 aa, Artificial Sequence
  chemically synthesized
SQVSPFKIPIEELEDRLFVNCNTSITRASSLSNCRHTSSVEE

SEQ ID NO: 2669 - protein, 42 aa, Artificial Sequence
  chemically synthesized
SQVSPFKIPIEELEDRFFVNCNTSITRASSLSNCRHTSSVEE

SEQ ID NO: 2670 - protein, 42 aa, Artificial Sequence
  chemically synthesized
SQVSPFKIPIEELEDRHFVNCNTSITRASSLSNCRHTSSVEE

SEQ ID NO: 2671 - protein, 42 aa, Artificial Sequence
  chemically synthesized
SQVSPFKIPIEELEDRMFVNCNTSITRASSLSNCRHTSSVEE

SEQ ID NO: 2672 - protein, 42 aa, Artificial Sequence; identical to SEQ ID NO: 1741
  chemically synthesized

SEQ ID NO: 2673 - protein, 42 aa, Artificial Sequence
  chemically synthesized
SQVSPFKIPIEELEDRVLVNCNTSITRASSLSNCRHTSSVEE

SEQ ID NO: 2674 - protein, 42 aa, Artificial Sequence
  chemically synthesized
SQVSPFKIPIEELEDRVVVNCNTSITRASSLSNCRHTSSVEE

SEQ ID NO: 2675 - protein, 42 aa, Artificial Sequence
  chemically synthesized
SQVSPFKIPIEELEDRVHVNCNTSITRASSLSNCRHTSSVEE

SEQ ID NO: 2676 - protein, 42 aa, Artificial Sequence
  chemically synthesized
SQVSPFKIPIEELEDRVMVNCNTSITRASSLSNCRHTSSVEE

SEQ ID NO: 2677 - protein, 42 aa, Artificial Sequence; identical to SEQ ID NO: 1858
  chemically synthesized

SEQ ID NO: 2678 - protein, 42 aa, Artificial Sequence
  chemically synthesized
SQVSPFKIPIEELEDRVFLNCNTSITRASSLSNCRHTSSVEE

SEQ ID NO: 2679 - protein, 42 aa, Artificial Sequence
  chemically synthesized
SQVSPFKIPIEELEDRVFFNCNTSITRASSLSNCRHTSSVEE

SEQ ID NO: 2680 - protein, 42 aa, Artificial Sequence
  chemically synthesized
SQVSPFKIPIEELEDRVFHNCNTSITRASSLSNCRHTSSVEE

SEQ ID NO: 2681 - protein, 42 aa, Artificial Sequence
  chemically synthesized
SQVSPFKIPIEELEDRVFMNCNTSITRASSLSNCRHTSSVEE

SEQ ID NO: 2682 - protein, 42 aa, Artificial Sequence; identical to SEQ ID NO: 1979
  chemically synthesized

SEQ ID NO: 2683 - protein, 42 aa, Artificial Sequence
  chemically synthesized
SQVSPFKIPIEELEDRVFVNSNTSITRASSLSNCRHTSSVEE

SEQ ID NO: 2684 - protein, 42 aa, Artificial Sequence
  chemically synthesized
SQVSPFKIPIEELEDRVFVNGNTSITRASSLSNCRHTSSVEE

SEQ ID NO: 2685 - protein, 42 aa, Artificial Sequence
  chemically synthesized
SQVSPFKIPIEELEDRVFVNANTSITRASSLSNCRHTSSVEE

SEQ ID NO: 2686 - protein, 42 aa, Artificial Sequence; identical to SEQ ID NO: 2220
  chemically synthesized

SEQ ID NO: 2687 - protein, 42 aa, Artificial Sequence; identical to SEQ ID NO: 2340
  chemically synthesized

SEQ ID NO: 2688 - protein, 42 aa, Artificial Sequence
  chemically synthesized
SQVSPFKIPIEELEDRVFVNCNYSITRASSLSNCRHTSSVEE

SEQ ID NO: 2689 - protein, 42 aa, Artificial Sequence; identical to SEQ ID NO: 2460
  chemically synthesized

SEQ ID NO: 2690 - protein, 42 aa, Artificial Sequence
  chemically synthesized
SQVSPFKIPIEELEDRVFVNCNTYITRASSLSNCRHTSSVEE

SEQ ID NO: 2691 - protein, 42 aa, Artificial Sequence
  chemically synthesized
SQVSPFKIPIEELEDRVFVNCNTSVTRASSLSNCRHTSSVEE

SEQ ID NO: 2692 - protein, 42 aa, Artificial Sequence; identical to SEQ ID NO: 2577
  chemically synthesized

SEQ ID NO: 2693 - protein, 42 aa, Artificial Sequence
  chemically synthesized
SQVSPFKIPIEELEDRVFVNCNTSHTRASSLSNCRHTSSVEE

SEQ ID NO: 2694 - protein, 42 aa, Artificial Sequence
  chemically synthesized
SQVSPFKIPIEELEDRVFVNCNTSFTRASSLSNCRHTSSVEE

SEQ ID NO: 2695 - protein, 42 aa, Artificial Sequence
  chemically synthesized
SQVSPFKIPIEELEDRVFVNCNTSMTRASSLSNCRHTSSVEE

SEQ ID NO: 2696 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSITXASSLSNCRHTSSVEE

SEQ ID NO: 2697 - protein, 42 aa, Artificial Sequence
  chemically synthesized
SQVSPFKIPIEELEDRVFVNCNTSITHASSLSNCRHTSSVEE

SEQ ID NO: 2698 - protein, 42 aa, Artificial Sequence
  chemically synthesized
SQVSPFKIPIEELEDRVFVNCNTSITKASSLSNCRHTSSVEE

SEQ ID NO: 2699 - protein, 42 aa, Artificial Sequence
  chemically synthesized
SQVSPFKIPIEELEDRVFVNCNTSITRGSSLSNCRHTSSVEE

SEQ ID NO: 2700 - protein, 42 aa, Artificial Sequence
  chemically synthesized
SQVSPFKIPIEELEDRVFVNCNTSITRATSLSNCRHTSSVEE

SEQ ID NO: 2701 - protein, 42 aa, Artificial Sequence
  chemically synthesized
SQVSPFKIPIEELEDRVFVNCNTSITRAYSLSNCRHTSSVEE

SEQ ID NO: 2702 - protein, 42 aa, Artificial Sequence
  chemically synthesized
SQVSPFKIPIEELEDRVFVNCNTSITRASTLSNCRHTSSVEE

SEQ ID NO: 2703 - protein, 42 aa, Artificial Sequence
  chemically synthesized
SQVSPFKIPIEELEDRVFVNCNTSITRASYLSNCRHTSSVEE

SEQ ID NO: 2704 - protein, 42 aa, Artificial Sequence
  chemically synthesized
SQVSPFKIPIEELEDRVFVNCNTSITRASSISNCRHTSSVEE

SEQ ID NO: 2705 - protein, 42 aa, Artificial Sequence
  chemically synthesized
SQVSPFKIPIEELEDRVFVNCNTSITRASSVSNCRHTSSVEE

SEQ ID NO: 2706 - protein, 42 aa, Artificial Sequence
  chemically synthesized
SQVSPFKIPIEELEDRVFVNCNTSITRASSFSNCRHTSSVEE

SEQ ID NO: 2707 - protein, 42 aa, Artificial Sequence
  chemically synthesized
SQVSPFKIPIEELEDRVFVNCNTSITRASSMSNCRHTSSVEE

SEQ ID NO: 2708 - protein, 42 aa, Artificial Sequence
  chemically synthesized
SQVSPFKIPIEELEDRVFVNCNTSITRASSHSNCRHTSSVEE

SEQ ID NO: 2709 - protein, 42 aa, Artificial Sequence
  chemically synthesized
SQVSPFKIPIEELEDRVFVNCNTSITRASSLTNCRHTSSVEE

SEQ ID NO: 2710 - protein, 42 aa, Artificial Sequence
  chemically synthesized
SQVSPFKIPIEELEDRVFVNCNTSITRASSLYNCRHTSSVEE

SEQ ID NO: 2711 - protein, 42 aa, Artificial Sequence
  chemically synthesized
SQVSPFKIPIEELEDRVFVNCNTSITRASSLSQCRHTSSVEE

SEQ ID NO: 2712 - protein, 42 aa, Artificial Sequence
  chemically synthesized
SQVSPFKIPIEELEDRVFVNCNTSITRASSLSNSRHTSSVEE

SEQ ID NO: 2713 - protein, 42 aa, Artificial Sequence
  chemically synthesized
SQVSPFKIPIEELEDRVFVNCNTSITRASSLSNGRHTSSVEE

SEQ ID NO: 2714 - protein, 42 aa, Artificial Sequence
  chemically synthesized
SQVSPFKIPIEELEDRVFVNCNTSITRASSLSNARHTSSVEE

SEQ ID NO: 2715 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSITRASSLSNCXHTSSVEE

SEQ ID NO: 2716 - protein, 42 aa, Artificial Sequence
  chemically synthesized
SQVSPFKIPIEELEDRVFVNCNTSITRASSLSNCHHTSSVEE

SEQ ID NO: 2717 - protein, 42 aa, Artificial Sequence
  chemically synthesized
SQVSPFKIPIEELEDRVFVNCNTSITRASSLSNCKHTSSVEE

SEQ ID NO: 2718 - protein, 42 aa, Artificial Sequence
  chemically synthesized
SQVSPFKIPIEELEDRVFVNCNTSITRASSLSNCRGTSSVEE

SEQ ID NO: 2719 - protein, 42 aa, Artificial Sequence
  chemically synthesized
SQVSPFKIPIEELEDRVFVNCNTSITRASSLSNCRATSSVEE

SEQ ID NO: 2720 - protein, 42 aa, Artificial Sequence
  chemically synthesized
SQVSPFKIPIEELEDRVFVNCNTSITRASSLSNCRITSSVEE

SEQ ID NO: 2721 - protein, 42 aa, Artificial Sequence
  chemically synthesized
SQVSPFKIPIEELEDRVFVNCNTSITRASSLSNCRLTSSVEE

SEQ ID NO: 2722 - protein, 42 aa, Artificial Sequence
  chemically synthesized
SQVSPFKIPIEELEDRVFVNCNTSITRASSLSNCRMTSSVEE

SEQ ID NO: 2723 - protein, 42 aa, Artificial Sequence
  chemically synthesized
SQVSPFKIPIEELEDRVFVNCNTSITRASSLSNCRVTSSVEE

SEQ ID NO: 2724 - protein, 42 aa, Artificial Sequence
  chemically synthesized
SQVSPFKIPIEELEDRVFVNCNTSITRASSLSNCRHSSSVEE

SEQ ID NO: 2725 - protein, 42 aa, Artificial Sequence
  chemically synthesized
SQVSPFKIPIEELEDRVFVNCNTSITRASSLSNCRHYSSVEE

SEQ ID NO: 2726 - protein, 42 aa, Artificial Sequence
  chemically synthesized
SQVSPFKIPIEELEDRVFVNCNTSITRASSLSNCRHTTSVEE

SEQ ID NO: 2727 - protein, 42 aa, Artificial Sequence
  chemically synthesized
SQVSPFKIPIEELEDRVFVNCNTSITRASSLSNCRHTYSVEE

SEQ ID NO: 2728 - protein, 42 aa, Artificial Sequence
  chemically synthesized
SQVSPFKIPIEELEDRVFVNCNTSITRASSLSNCRHTSTVEE

SEQ ID NO: 2729 - protein, 42 aa, Artificial Sequence
  chemically synthesized
SQVSPFKIPIEELEDRVFVNCNTSITRASSLSNCRHTSYVEE

SEQ ID NO: 2730 - protein, 42 aa, Artificial Sequence
  chemically synthesized
SQVSPFKIPIEELEDRVFVNCNTSITRASSLSNCRHTSSIEE

SEQ ID NO: 2731 - protein, 42 aa, Artificial Sequence
  chemically synthesized
SQVSPFKIPIEELEDRVFVNCNTSITRASSLSNCRHTSSLEE

SEQ ID NO: 2732 - protein, 42 aa, Artificial Sequence
  chemically synthesized
SQVSPFKIPIEELEDRVFVNCNTSITRASSLSNCRHTSSFEE

SEQ ID NO: 2733 - protein, 42 aa, Artificial Sequence
  chemically synthesized
SQVSPFKIPIEELEDRVFVNCNTSITRASSLSNCRHTSSHEE

SEQ ID NO: 2734 - protein, 42 aa, Artificial Sequence
  chemically synthesized
SQVSPFKIPIEELEDRVFVNCNTSITRASSLSNCRHTSSMEE

SEQ ID NO: 2735 - protein, 42 aa, Artificial Sequence
  chemically synthesized
SQVSPFKIPIEELEDRVFVNCNTSITRASSLSNCRHTSSVDE

SEQ ID NO: 2736 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSITRASSLSNCRHTSSVXE

SEQ ID NO: 2737 - protein, 42 aa, Artificial Sequence
  chemically synthesized
SQVSPFKIPIEELEDRVFVNCNTSITRASSLSNCRHTSSVED

SEQ ID NO: 2738 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSITRASSLSNCRHTSSVEX

SEQ ID NO: 2739 - protein, 42 aa, Artificial Sequence
  chemically synthesized
SQVSAFKIPIEELEDRVFVNCNTSITRASSLSNCRHTSSVEE

SEQ ID NO: 2740 - protein, 42 aa, Artificial Sequence
  chemically synthesized
SQVSGFKIPIEELEDRVFVNCNTSITRASSLSNCRHTSSVEE

SEQ ID NO: 2741 - protein, 42 aa, Artificial Sequence
  chemically synthesized
SQVSPFKIAIEELEDRVFVNCNTSITRASSLSNCRHTSSVEE

SEQ ID NO: 2742 - protein, 42 aa, Artificial Sequence
  chemically synthesized
SQVSPFKIGIEELEDRVFVNCNTSITRASSLSNCRHTSSVEE

SEQ ID NO: 2743 - protein, 42 aa, Artificial Sequence; identical to SEQ ID NO: 81
  chemically synthesized

SEQ ID NO: 2744 - protein, 42 aa, Artificial Sequence; identical to SEQ ID NO: 200
  chemically synthesized

SEQ ID NO: 2745 - protein, 42 aa, Artificial Sequence
  chemically synthesized
YQVSPFKIPIEELEDRVFVNCNTSIYKASSLSNCRHTSSVEE

SEQ ID NO: 2746 - protein, 42 aa, Artificial Sequence; identical to SEQ ID NO: 320
  chemically synthesized

SEQ ID NO: 2747 - protein, 42 aa, Artificial Sequence; identical to SEQ ID NO: 438
  chemically synthesized

SEQ ID NO: 2748 - protein, 42 aa, Artificial Sequence
  chemically synthesized
SQISPFKIPIEELEDRVFVNCNTSIYKASSLSNCRHTSSVEE

SEQ ID NO: 2749 - protein, 42 aa, Artificial Sequence
  chemically synthesized
SQPSPFKIPIEELEDRVFVNCNTSIYKASSLSNCRHTSSVEE

SEQ ID NO: 2750 - protein, 42 aa, Artificial Sequence
  chemically synthesized
SQFSPFKIPIEELEDRVFVNCNTSIYKASSLSNCRHTSSVEE

SEQ ID NO: 2751 - protein, 42 aa, Artificial Sequence; identical to SEQ ID NO: 557
  chemically synthesized

SEQ ID NO: 2752 - protein, 42 aa, Artificial Sequence
  chemically synthesized
SQVYPFKIPIEELEDRVFVNCNTSIYKASSLSNCRHTSSVEE

SEQ ID NO: 2753 - protein, 42 aa, Artificial Sequence
  chemically synthesized
SQVSPWKIPIEELEDRVFVNCNTSIYKASSLSNCRHTSSVEE

SEQ ID NO: 2754 - protein, 42 aa, Artificial Sequence
  chemically synthesized
SQVSPYKIPIEELEDRVFVNCNTSIYKASSLSNCRHTSSVEE

SEQ ID NO: 2755 - protein, 42 aa, Artificial Sequence
  chemically synthesized
SQVSPHKIPIEELEDRVFVNCNTSIYKASSLSNCRHTSSVEE

SEQ ID NO: 2756 - protein, 42 aa, Artificial Sequence
  chemically synthesized
SQVSPFRIPIEELEDRVFVNCNTSIYKASSLSNCRHTSSVEE

SEQ ID NO: 2757 - protein, 42 aa, Artificial Sequence
  chemically synthesized
SQVSPFHIPIEELEDRVFVNCNTSIYKASSLSNCRHTSSVEE

SEQ ID NO: 2758 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYKASSLSNCRHTSSVEE

SEQ ID NO: 2759 - protein, 42 aa, Artificial Sequence; identical to SEQ ID NO: 796
  chemically synthesized

SEQ ID NO: 2760 - protein, 42 aa, Artificial Sequence
  chemically synthesized
SQVSPFKHPIEELEDRVFVNCNTSIYKASSLSNCRHTSSVEE

SEQ ID NO: 2761 - protein, 42 aa, Artificial Sequence
  chemically synthesized
SQVSPFKVPIEELEDRVFVNCNTSIYKASSLSNCRHTSSVEE

SEQ ID NO: 2762 - protein, 42 aa, Artificial Sequence
  chemically synthesized
SQVSPFKFPIEELEDRVFVNCNTSIYKASSLSNCRHTSSVEE

SEQ ID NO: 2763 - protein, 42 aa, Artificial Sequence
  chemically synthesized
SQVSPFKMPIEELEDRVFVNCNTSIYKASSLSNCRHTSSVEE

SEQ ID NO: 2764 - protein, 42 aa, Artificial Sequence; identical to SEQ ID NO: 914
  chemically synthesized

SEQ ID NO: 2765 - protein, 42 aa, Artificial Sequence
  chemically synthesized
SQVSPFKIPHEELEDRVFVNCNTSIYKASSLSNCRHTSSVEE

SEQ ID NO: 2766 - protein, 42 aa, Artificial Sequence
  chemically synthesized
SQVSPFKIPVEELEDRVFVNCNTSIYKASSLSNCRHTSSVEE

SEQ ID NO: 2767 - protein, 42 aa, Artificial Sequence
  chemically synthesized
SQVSPFKIPFEELEDRVFVNCNTSIYKASSLSNCRHTSSVEE

SEQ ID NO: 2768 - protein, 42 aa, Artificial Sequence
  chemically synthesized
SQVSPFKIPMEELEDRVFVNCNTSIYKASSLSNCRHTSSVEE

SEQ ID NO: 2769 - protein, 42 aa, Artificial Sequence; identical to SEQ ID NO: 1034
  chemically synthesized

SEQ ID NO: 2770 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYKASSLSNCRHTSSVEE

SEQ ID NO: 2771 - protein, 42 aa, Artificial Sequence; identical to SEQ ID NO: 1154
  chemically synthesized

SEQ ID NO: 2772 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYKASSLSNCRHTSSVEE

SEQ ID NO: 2773 - protein, 42 aa, Artificial Sequence
  chemically synthesized
SQVSPFKIPIEEVEDRVFVNCNTSIYKASSLSNCRHTSSVEE

SEQ ID NO: 2774 - protein, 42 aa, Artificial Sequence; identical to SEQ ID NO: 1271
  chemically synthesized

SEQ ID NO: 2775 - protein, 42 aa, Artificial Sequence
  chemically synthesized
SQVSPFKIPIEEFEDRVFVNCNTSIYKASSLSNCRHTSSVEE

SEQ ID NO: 2776 - protein, 42 aa, Artificial Sequence
  chemically synthesized
SQVSPFKIPIEEHEDRVFVNCNTSIYKASSLSNCRHTSSVEE

SEQ ID NO: 2777 - protein, 42 aa, Artificial Sequence
  chemically synthesized
SQVSPFKIPIEEMEDRVFVNCNTSIYKASSLSNCRHTSSVEE

SEQ ID NO: 2778 - protein, 42 aa, Artificial Sequence; identical to SEQ ID NO: 1391
  chemically synthesized

SEQ ID NO: 2779 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYKASSLSNCRHTSSVEE

SEQ ID NO: 2780 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYKASSLSNCRHTSSVEE

SEQ ID NO: 2781 - protein, 42 aa, Artificial Sequence
  chemically synthesized
SQVSPFKIPIEELEERVFVNCNTSIYKASSLSNCRHTSSVEE

SEQ ID NO: 2782 - protein, 42 aa, Artificial Sequence; identical to SEQ ID NO: 1510
  chemically synthesized

SEQ ID NO: 2783 - protein, 42 aa, Artificial Sequence
  chemically synthesized
SQVSPFKIPIEELEDHVFVNCNTSIYKASSLSNCRHTSSVEE

SEQ ID NO: 2784 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYKASSLSNCRHTSSVEE

SEQ ID NO: 2785 - protein, 42 aa, Artificial Sequence; identical to SEQ ID NO: 1627
  chemically synthesized

SEQ ID NO: 2786 - protein, 42 aa, Artificial Sequence
  chemically synthesized
SQVSPFKIPIEELEDRLFVNCNTSIYKASSLSNCRHTSSVEE

SEQ ID NO: 2787 - protein, 42 aa, Artificial Sequence
  chemically synthesized
SQVSPFKIPIEELEDRFFVNCNTSIYKASSLSNCRHTSSVEE

SEQ ID NO: 2788 - protein, 42 aa, Artificial Sequence
  chemically synthesized
SQVSPFKIPIEELEDRHFVNCNTSIYKASSLSNCRHTSSVEE

SEQ ID NO: 2789 - protein, 42 aa, Artificial Sequence
  chemically synthesized
SQVSPFKIPIEELEDRMFVNCNTSIYKASSLSNCRHTSSVEE

SEQ ID NO: 2790 - protein, 42 aa, Artificial Sequence; identical to SEQ ID NO: 1744
  chemically synthesized

SEQ ID NO: 2791 - protein, 42 aa, Artificial Sequence
  chemically synthesized
SQVSPFKIPIEELEDRVLVNCNTSIYKASSLSNCRHTSSVEE

SEQ ID NO: 2792 - protein, 42 aa, Artificial Sequence
  chemically synthesized
SQVSPFKIPIEELEDRVVVNCNTSIYKASSLSNCRHTSSVEE

SEQ ID NO: 2793 - protein, 42 aa, Artificial Sequence
  chemically synthesized
SQVSPFKIPIEELEDRVHVNCNTSIYKASSLSNCRHTSSVEE

SEQ ID NO: 2794 - protein, 42 aa, Artificial Sequence
  chemically synthesized
SQVSPFKIPIEELEDRVMVNCNTSIYKASSLSNCRHTSSVEE

SEQ ID NO: 2795 - protein, 42 aa, Artificial Sequence; identical to SEQ ID NO: 1861
  chemically synthesized

SEQ ID NO: 2796 - protein, 42 aa, Artificial Sequence
  chemically synthesized
SQVSPFKIPIEELEDRVFLNCNTSIYKASSLSNCRHTSSVEE

SEQ ID NO: 2797 - protein, 42 aa, Artificial Sequence
  chemically synthesized
SQVSPFKIPIEELEDRVFFNCNTSIYKASSLSNCRHTSSVEE

SEQ ID NO: 2798 - protein, 42 aa, Artificial Sequence
  chemically synthesized
SQVSPFKIPIEELEDRVFHNCNTSIYKASSLSNCRHTSSVEE

SEQ ID NO: 2799 - protein, 42 aa, Artificial Sequence
  chemically synthesized
SQVSPFKIPIEELEDRVFMNCNTSIYKASSLSNCRHTSSVEE

SEQ ID NO: 2800 - protein, 42 aa, Artificial Sequence; identical to SEQ ID NO: 1982
  chemically synthesized

SEQ ID NO: 2801 - protein, 42 aa, Artificial Sequence
  chemically synthesized
SQVSPFKIPIEELEDRVFVNSNTSIYKASSLSNCRHTSSVEE

SEQ ID NO: 2802 - protein, 42 aa, Artificial Sequence
  chemically synthesized
SQVSPFKIPIEELEDRVFVNGNTSIYKASSLSNCRHTSSVEE

SEQ ID NO: 2803 - protein, 42 aa, Artificial Sequence
  chemically synthesized
SQVSPFKIPIEELEDRVFVNANTSIYKASSLSNCRHTSSVEE

SEQ ID NO: 2804 - protein, 42 aa, Artificial Sequence; identical to SEQ ID NO: 2223
  chemically synthesized

SEQ ID NO: 2805 - protein, 42 aa, Artificial Sequence; identical to SEQ ID NO: 2343
  chemically synthesized

SEQ ID NO: 2806 - protein, 42 aa, Artificial Sequence
  chemically synthesized
SQVSPFKIPIEELEDRVFVNCNYSIYKASSLSNCRHTSSVEE

SEQ ID NO: 2807 - protein, 42 aa, Artificial Sequence; identical to SEQ ID NO: 2463
  chemically synthesized

SEQ ID NO: 2808 - protein, 42 aa, Artificial Sequence
  chemically synthesized
SQVSPFKIPIEELEDRVFVNCNTYIYKASSLSNCRHTSSVEE

SEQ ID NO: 2809 - protein, 42 aa, Artificial Sequence
  chemically synthesized
SQVSPFKIPIEELEDRVFVNCNTSVYKASSLSNCRHTSSVEE

SEQ ID NO: 2810 - protein, 42 aa, Artificial Sequence; identical to SEQ ID NO: 2580
  chemically synthesized

SEQ ID NO: 2811 - protein, 42 aa, Artificial Sequence
  chemically synthesized
SQVSPFKIPIEELEDRVFVNCNTSHYKASSLSNCRHTSSVEE

SEQ ID NO: 2812 - protein, 42 aa, Artificial Sequence
  chemically synthesized
SQVSPFKIPIEELEDRVFVNCNTSFYKASSLSNCRHTSSVEE

SEQ ID NO: 2813 - protein, 42 aa, Artificial Sequence
  chemically synthesized
SQVSPFKIPIEELEDRVFVNCNTSMYKASSLSNCRHTSSVEE

SEQ ID NO: 2814 - protein, 42 aa, Artificial Sequence
  chemically synthesized
SQVSPFKIPIEELEDRVFVNCNTSIWKASSLSNCRHTSSVEE

SEQ ID NO: 2815 - protein, 42 aa, Artificial Sequence
  chemically synthesized
SQVSPFKIPIEELEDRVFVNCNTSIFKASSLSNCRHTSSVEE

SEQ ID NO: 2816 - protein, 42 aa, Artificial Sequence
  chemically synthesized
SQVSPFKIPIEELEDRVFVNCNTSISKASSLSNCRHTSSVEE

SEQ ID NO: 2817 - protein, 42 aa, Artificial Sequence; identical to SEQ ID NO: 2698
  chemically synthesized

SEQ ID NO: 2818 - protein, 42 aa, Artificial Sequence
  chemically synthesized
SQVSPFKIPIEELEDRVFVNCNTSIYKGSSLSNCRHTSSVEE

SEQ ID NO: 2819 - protein, 42 aa, Artificial Sequence
  chemically synthesized
SQVSPFKIPIEELEDRVFVNCNTSIYKATSLSNCRHTSSVEE

SEQ ID NO: 2820 - protein, 42 aa, Artificial Sequence
  chemically synthesized
SQVSPFKIPIEELEDRVFVNCNTSIYKAYSLSNCRHTSSVEE

SEQ ID NO: 2821 - protein, 42 aa, Artificial Sequence
  chemically synthesized
SQVSPFKIPIEELEDRVFVNCNTSIYKASTLSNCRHTSSVEE

SEQ ID NO: 2822 - protein, 42 aa, Artificial Sequence
  chemically synthesized
SQVSPFKIPIEELEDRVFVNCNTSIYKASYLSNCRHTSSVEE

SEQ ID NO: 2823 - protein, 42 aa, Artificial Sequence
  chemically synthesized
SQVSPFKIPIEELEDRVFVNCNTSIYKASSISNCRHTSSVEE

SEQ ID NO: 2824 - protein, 42 aa, Artificial Sequence
  chemically synthesized
SQVSPFKIPIEELEDRVFVNCNTSIYKASSVSNCRHTSSVEE

SEQ ID NO: 2825 - protein, 42 aa, Artificial Sequence
  chemically synthesized
SQVSPFKIPIEELEDRVFVNCNTSIYKASSFSNCRHTSSVEE

SEQ ID NO: 2826 - protein, 42 aa, Artificial Sequence
  chemically synthesized
SQVSPFKIPIEELEDRVFVNCNTSIYKASSMSNCRHTSSVEE

SEQ ID NO: 2827 - protein, 42 aa, Artificial Sequence
  chemically synthesized
SQVSPFKIPIEELEDRVFVNCNTSIYKASSHSNCRHTSSVEE

SEQ ID NO: 2828 - protein, 42 aa, Artificial Sequence
  chemically synthesized
SQVSPFKIPIEELEDRVFVNCNTSIYKASSLTNCRHTSSVEE

SEQ ID NO: 2829 - protein, 42 aa, Artificial Sequence
  chemically synthesized
SQVSPFKIPIEELEDRVFVNCNTSIYKASSLYNCRHTSSVEE

SEQ ID NO: 2830 - protein, 42 aa, Artificial Sequence
  chemically synthesized
SQVSPFKIPIEELEDRVFVNCNTSIYKASSLSQCRHTSSVEE

SEQ ID NO: 2831 - protein, 42 aa, Artificial Sequence
  chemically synthesized
SQVSPFKIPIEELEDRVFVNCNTSIYKASSLSNSRHTSSVEE

SEQ ID NO: 2832 - protein, 42 aa, Artificial Sequence
  chemically synthesized
SQVSPFKIPIEELEDRVFVNCNTSIYKASSLSNGRHTSSVEE

SEQ ID NO: 2833 - protein, 42 aa, Artificial Sequence
  chemically synthesized
SQVSPFKIPIEELEDRVFVNCNTSIYKASSLSNARHTSSVEE

SEQ ID NO: 2834 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYKASSLSNCXHTSSVEE

SEQ ID NO: 2835 - protein, 42 aa, Artificial Sequence
  chemically synthesized
SQVSPFKIPIEELEDRVFVNCNTSIYKASSLSNCHHTSSVEE

SEQ ID NO: 2836 - protein, 42 aa, Artificial Sequence
  chemically synthesized
SQVSPFKIPIEELEDRVFVNCNTSIYKASSLSNCKHTSSVEE

SEQ ID NO: 2837 - protein, 42 aa, Artificial Sequence
  chemically synthesized
SQVSPFKIPIEELEDRVFVNCNTSIYKASSLSNCRGTSSVEE

SEQ ID NO: 2838 - protein, 42 aa, Artificial Sequence
  chemically synthesized
SQVSPFKIPIEELEDRVFVNCNTSIYKASSLSNCRATSSVEE

SEQ ID NO: 2839 - protein, 42 aa, Artificial Sequence
  chemically synthesized
SQVSPFKIPIEELEDRVFVNCNTSIYKASSLSNCRITSSVEE

SEQ ID NO: 2840 - protein, 42 aa, Artificial Sequence
  chemically synthesized
SQVSPFKIPIEELEDRVFVNCNTSIYKASSLSNCRLTSSVEE

SEQ ID NO: 2841 - protein, 42 aa, Artificial Sequence
  chemically synthesized
SQVSPFKIPIEELEDRVFVNCNTSIYKASSLSNCRMTSSVEE

SEQ ID NO: 2842 - protein, 42 aa, Artificial Sequence
  chemically synthesized
SQVSPFKIPIEELEDRVFVNCNTSIYKASSLSNCRVTSSVEE

SEQ ID NO: 2843 - protein, 42 aa, Artificial Sequence
  chemically synthesized
SQVSPFKIPIEELEDRVFVNCNTSIYKASSLSNCRHSSSVEE

SEQ ID NO: 2844 - protein, 42 aa, Artificial Sequence
  chemically synthesized
SQVSPFKIPIEELEDRVFVNCNTSIYKASSLSNCRHYSSVEE

SEQ ID NO: 2845 - protein, 42 aa, Artificial Sequence
  chemically synthesized
SQVSPFKIPIEELEDRVFVNCNTSIYKASSLSNCRHTTSVEE

SEQ ID NO: 2846 - protein, 42 aa, Artificial Sequence
  chemically synthesized
SQVSPFKIPIEELEDRVFVNCNTSIYKASSLSNCRHTYSVEE

SEQ ID NO: 2847 - protein, 42 aa, Artificial Sequence
  chemically synthesized
SQVSPFKIPIEELEDRVFVNCNTSIYKASSLSNCRHTSTVEE

SEQ ID NO: 2848 - protein, 42 aa, Artificial Sequence
  chemically synthesized
SQVSPFKIPIEELEDRVFVNCNTSIYKASSLSNCRHTSYVEE

SEQ ID NO: 2849 - protein, 42 aa, Artificial Sequence
  chemically synthesized
SQVSPFKIPIEELEDRVFVNCNTSIYKASSLSNCRHTSSIEE

SEQ ID NO: 2850 - protein, 42 aa, Artificial Sequence
  chemically synthesized
SQVSPFKIPIEELEDRVFVNCNTSIYKASSLSNCRHTSSLEE

SEQ ID NO: 2851 - protein, 42 aa, Artificial Sequence
  chemically synthesized
SQVSPFKIPIEELEDRVFVNCNTSIYKASSLSNCRHTSSFEE

SEQ ID NO: 2852 - protein, 42 aa, Artificial Sequence
  chemically synthesized
SQVSPFKIPIEELEDRVFVNCNTSIYKASSLSNCRHTSSHEE

SEQ ID NO: 2853 - protein, 42 aa, Artificial Sequence
  chemically synthesized
SQVSPFKIPIEELEDRVFVNCNTSIYKASSLSNCRHTSSMEE

SEQ ID NO: 2854 - protein, 42 aa, Artificial Sequence
  chemically synthesized
SQVSPFKIPIEELEDRVFVNCNTSIYKASSLSNCRHTSSVDE

SEQ ID NO: 2855 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYKASSLSNCRHTSSVXE

SEQ ID NO: 2856 - protein, 42 aa, Artificial Sequence
  chemically synthesized
SQVSPFKIPIEELEDRVFVNCNTSIYKASSLSNCRHTSSVED

SEQ ID NO: 2857 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYKASSLSNCRHTSSVEX

SEQ ID NO: 2858 - protein, 42 aa, Artificial Sequence
  chemically synthesized
SQVSAFKIPIEELEDRVFVNCNTSIYKASSLSNCRHTSSVEE

SEQ ID NO: 2859 - protein, 42 aa, Artificial Sequence
  chemically synthesized
SQVSGFKIPIEELEDRVFVNCNTSIYKASSLSNCRHTSSVEE

SEQ ID NO: 2860 - protein, 42 aa, Artificial Sequence
  chemically synthesized
SQVSPFKIAIEELEDRVFVNCNTSIYKASSLSNCRHTSSVEE

SEQ ID NO: 2861 - protein, 42 aa, Artificial Sequence
  chemically synthesized
SQVSPFKIGIEELEDRVFVNCNTSIYKASSLSNCRHTSSVEE

SEQ ID NO: 2862 - protein, 42 aa, Artificial Sequence; identical to SEQ ID NO: 82
  chemically synthesized

SEQ ID NO: 2863 - protein, 42 aa, Artificial Sequence; identical to SEQ ID NO: 201
  chemically synthesized

SEQ ID NO: 2864 - protein, 42 aa, Artificial Sequence
  chemically synthesized
YQVSPFKIPIEELEDRVFVNCNTSIYRGSSLSNCRHTSSVEE

SEQ ID NO: 2865 - protein, 42 aa, Artificial Sequence; identical to SEQ ID NO: 321
  chemically synthesized

SEQ ID NO: 2866 - protein, 42 aa, Artificial Sequence; identical to SEQ ID NO: 439
  chemically synthesized

SEQ ID NO: 2867 - protein, 42 aa, Artificial Sequence
  chemically synthesized
SQISPFKIPIEELEDRVFVNCNTSIYRGSSLSNCRHTSSVEE

SEQ ID NO: 2868 - protein, 42 aa, Artificial Sequence
  chemically synthesized
SQPSPFKIPIEELEDRVFVNCNTSIYRGSSLSNCRHTSSVEE

SEQ ID NO: 2869 - protein, 42 aa, Artificial Sequence
  chemically synthesized
SQFSPFKIPIEELEDRVFVNCNTSIYRGSSLSNCRHTSSVEE

SEQ ID NO: 2870 - protein, 42 aa, Artificial Sequence; identical to SEQ ID NO: 558
  chemically synthesized

SEQ ID NO: 2871 - protein, 42 aa, Artificial Sequence
  chemically synthesized
SQVYPFKIPIEELEDRVFVNCNTSIYRGSSLSNCRHTSSVEE

SEQ ID NO: 2872 - protein, 42 aa, Artificial Sequence
  chemically synthesized
SQVSPWKIPIEELEDRVFVNCNTSIYRGSSLSNCRHTSSVEE

SEQ ID NO: 2873 - protein, 42 aa, Artificial Sequence
  chemically synthesized
SQVSPYKIPIEELEDRVFVNCNTSIYRGSSLSNCRHTSSVEE

SEQ ID NO: 2874 - protein, 42 aa, Artificial Sequence
  chemically synthesized
SQVSPHKIPIEELEDRVFVNCNTSIYRGSSLSNCRHTSSVEE

SEQ ID NO: 2875 - protein, 42 aa, Artificial Sequence
  chemically synthesized
SQVSPFRIPIEELEDRVFVNCNTSIYRGSSLSNCRHTSSVEE

SEQ ID NO: 2876 - protein, 42 aa, Artificial Sequence
  chemically synthesized
SQVSPFHIPIEELEDRVFVNCNTSIYRGSSLSNCRHTSSVEE

SEQ ID NO: 2877 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRGSSLSNCRHTSSVEE

SEQ ID NO: 2878 - protein, 42 aa, Artificial Sequence; identical to SEQ ID NO: 797
  chemically synthesized

SEQ ID NO: 2879 - protein, 42 aa, Artificial Sequence
  chemically synthesized
SQVSPFKHPIEELEDRVFVNCNTSIYRGSSLSNCRHTSSVEE

SEQ ID NO: 2880 - protein, 42 aa, Artificial Sequence
  chemically synthesized
SQVSPFKVPIEELEDRVFVNCNTSIYRGSSLSNCRHTSSVEE

SEQ ID NO: 2881 - protein, 42 aa, Artificial Sequence
  chemically synthesized
SQVSPFKFPIEELEDRVFVNCNTSIYRGSSLSNCRHTSSVEE

SEQ ID NO: 2882 - protein, 42 aa, Artificial Sequence
  chemically synthesized
SQVSPFKMPIEELEDRVFVNCNTSIYRGSSLSNCRHTSSVEE

SEQ ID NO: 2883 - protein, 42 aa, Artificial Sequence; identical to SEQ ID NO: 915
  chemically synthesized

SEQ ID NO: 2884 - protein, 42 aa, Artificial Sequence
  chemically synthesized
SQVSPFKIPHEELEDRVFVNCNTSIYRGSSLSNCRHTSSVEE

SEQ ID NO: 2885 - protein, 42 aa, Artificial Sequence
  chemically synthesized
SQVSPFKIPVEELEDRVFVNCNTSIYRGSSLSNCRHTSSVEE

SEQ ID NO: 2886 - protein, 42 aa, Artificial Sequence
  chemically synthesized
SQVSPFKIPFEELEDRVFVNCNTSIYRGSSLSNCRHTSSVEE

SEQ ID NO: 2887 - protein, 42 aa, Artificial Sequence
  chemically synthesized
SQVSPFKIPMEELEDRVFVNCNTSIYRGSSLSNCRHTSSVEE

SEQ ID NO: 2888 - protein, 42 aa, Artificial Sequence; identical to SEQ ID NO: 1035
  chemically synthesized

SEQ ID NO: 2889 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRGSSLSNCRHTSSVEE

SEQ ID NO: 2890 - protein, 42 aa, Artificial Sequence; identical to SEQ ID NO: 1155
  chemically synthesized

SEQ ID NO: 2891 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRGSSLSNCRHTSSVEE

SEQ ID NO: 2892 - protein, 42 aa, Artificial Sequence
  chemically synthesized
SQVSPFKIPIEEVEDRVFVNCNTSIYRGSSLSNCRHTSSVEE

SEQ ID NO: 2893 - protein, 42 aa, Artificial Sequence; identical to SEQ ID NO: 1272
  chemically synthesized

SEQ ID NO: 2894 - protein, 42 aa, Artificial Sequence
  chemically synthesized
SQVSPFKIPIEEFEDRVFVNCNTSIYRGSSLSNCRHTSSVEE

SEQ ID NO: 2895 - protein, 42 aa, Artificial Sequence
  chemically synthesized
SQVSPFKIPIEEHEDRVFVNCNTSIYRGSSLSNCRHTSSVEE

SEQ ID NO: 2896 - protein, 42 aa, Artificial Sequence
  chemically synthesized
SQVSPFKIPIEEMEDRVFVNCNTSIYRGSSLSNCRHTSSVEE

SEQ ID NO: 2897 - protein, 42 aa, Artificial Sequence; identical to SEQ ID NO: 1392
  chemically synthesized

SEQ ID NO: 2898 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRGSSLSNCRHTSSVEE

SEQ ID NO: 2899 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRGSSLSNCRHTSSVEE

SEQ ID NO: 2900 - protein, 42 aa, Artificial Sequence
  chemically synthesized
SQVSPFKIPIEELEERVFVNCNTSIYRGSSLSNCRHTSSVEE

SEQ ID NO: 2901 - protein, 42 aa, Artificial Sequence; identical to SEQ ID NO: 1511
  chemically synthesized

SEQ ID NO: 2902 - protein, 42 aa, Artificial Sequence
  chemically synthesized
SQVSPFKIPIEELEDHVFVNCNTSIYRGSSLSNCRHTSSVEE

SEQ ID NO: 2903 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRGSSLSNCRHTSSVEE

SEQ ID NO: 2904 - protein, 42 aa, Artificial Sequence; identical to SEQ ID NO: 1628
  chemically synthesized

SEQ ID NO: 2905 - protein, 42 aa, Artificial Sequence
  chemically synthesized
SQVSPFKIPIEELEDRLFVNCNTSIYRGSSLSNCRHTSSVEE

SEQ ID NO: 2906 - protein, 42 aa, Artificial Sequence
  chemically synthesized
SQVSPFKIPIEELEDRFFVNCNTSIYRGSSLSNCRHTSSVEE

SEQ ID NO: 2907 - protein, 42 aa, Artificial Sequence
  chemically synthesized
SQVSPFKIPIEELEDRHFVNCNTSIYRGSSLSNCRHTSSVEE

SEQ ID NO: 2908 - protein, 42 aa, Artificial Sequence
  chemically synthesized
SQVSPFKIPIEELEDRMFVNCNTSIYRGSSLSNCRHTSSVEE

SEQ ID NO: 2909 - protein, 42 aa, Artificial Sequence; identical to SEQ ID NO: 1745
  chemically synthesized

SEQ ID NO: 2910 - protein, 42 aa, Artificial Sequence
  chemically synthesized
SQVSPFKIPIEELEDRVLVNCNTSIYRGSSLSNCRHTSSVEE

SEQ ID NO: 2911 - protein, 42 aa, Artificial Sequence
  chemically synthesized
SQVSPFKIPIEELEDRVVVNCNTSIYRGSSLSNCRHTSSVEE

SEQ ID NO: 2912 - protein, 42 aa, Artificial Sequence
  chemically synthesized
SQVSPFKIPIEELEDRVHVNCNTSIYRGSSLSNCRHTSSVEE

SEQ ID NO: 2913 - protein, 42 aa, Artificial Sequence
  chemically synthesized
SQVSPFKIPIEELEDRVMVNCNTSIYRGSSLSNCRHTSSVEE

SEQ ID NO: 2914 - protein, 42 aa, Artificial Sequence; identical to SEQ ID NO: 1862
  chemically synthesized

SEQ ID NO: 2915 - protein, 42 aa, Artificial Sequence
  chemically synthesized
SQVSPFKIPIEELEDRVFLNCNTSIYRGSSLSNCRHTSSVEE

SEQ ID NO: 2916 - protein, 42 aa, Artificial Sequence
  chemically synthesized
SQVSPFKIPIEELEDRVFFNCNTSIYRGSSLSNCRHTSSVEE

SEQ ID NO: 2917 - protein, 42 aa, Artificial Sequence
  chemically synthesized
SQVSPFKIPIEELEDRVFHNCNTSIYRGSSLSNCRHTSSVEE

SEQ ID NO: 2918 - protein, 42 aa, Artificial Sequence
  chemically synthesized
SQVSPFKIPIEELEDRVFMNCNTSIYRGSSLSNCRHTSSVEE

SEQ ID NO: 2919 - protein, 42 aa, Artificial Sequence; identical to SEQ ID NO: 1983
  chemically synthesized

SEQ ID NO: 2920 - protein, 42 aa, Artificial Sequence
  chemically synthesized
SQVSPFKIPIEELEDRVFVNSNTSIYRGSSLSNCRHTSSVEE

SEQ ID NO: 2921 - protein, 42 aa, Artificial Sequence
  chemically synthesized
SQVSPFKIPIEELEDRVFVNGNTSIYRGSSLSNCRHTSSVEE

SEQ ID NO: 2922 - protein, 42 aa, Artificial Sequence; identical to SEQ ID NO: 2921
  chemically synthesized

SEQ ID NO: 2923 - protein, 42 aa, Artificial Sequence; identical to SEQ ID NO: 2224
  chemically synthesized

SEQ ID NO: 2924 - protein, 42 aa, Artificial Sequence; identical to SEQ ID NO: 2344
  chemically synthesized

SEQ ID NO: 2925 - protein, 42 aa, Artificial Sequence
  chemically synthesized
SQVSPFKIPIEELEDRVFVNCNYSIYRGSSLSNCRHTSSVEE

SEQ ID NO: 2926 - protein, 42 aa, Artificial Sequence; identical to SEQ ID NO: 2464
  chemically synthesized

SEQ ID NO: 2927 - protein, 42 aa, Artificial Sequence
  chemically synthesized
SQVSPFKIPIEELEDRVFVNCNTYIYRGSSLSNCRHTSSVEE

SEQ ID NO: 2928 - protein, 42 aa, Artificial Sequence
  chemically synthesized
SQVSPFKIPIEELEDRVFVNCNTSVYRGSSLSNCRHTSSVEE

SEQ ID NO: 2929 - protein, 42 aa, Artificial Sequence; identical to SEQ ID NO: 2581
  chemically synthesized

SEQ ID NO: 2930 - protein, 42 aa, Artificial Sequence
  chemically synthesized
SQVSPFKIPIEELEDRVFVNCNTSHYRGSSLSNCRHTSSVEE

SEQ ID NO: 2931 - protein, 42 aa, Artificial Sequence
  chemically synthesized
SQVSPFKIPIEELEDRVFVNCNTSFYRGSSLSNCRHTSSVEE

SEQ ID NO: 2932 - protein, 42 aa, Artificial Sequence
  chemically synthesized
SQVSPFKIPIEELEDRVFVNCNTSMYRGSSLSNCRHTSSVEE

SEQ ID NO: 2933 - protein, 42 aa, Artificial Sequence
  chemically synthesized
SQVSPFKIPIEELEDRVFVNCNTSIWRGSSLSNCRHTSSVEE

SEQ ID NO: 2934 - protein, 42 aa, Artificial Sequence
  chemically synthesized
SQVSPFKIPIEELEDRVFVNCNTSIFRGSSLSNCRHTSSVEE

SEQ ID NO: 2935 - protein, 42 aa, Artificial Sequence
  chemically synthesized
SQVSPFKIPIEELEDRVFVNCNTSISRGSSLSNCRHTSSVEE

SEQ ID NO: 2936 - protein, 42 aa, Artificial Sequence; identical to SEQ ID NO: 2699
  chemically synthesized

SEQ ID NO: 2937 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXGSSLSNCRHTSSVEE

SEQ ID NO: 2938 - protein, 42 aa, Artificial Sequence
  chemically synthesized
SQVSPFKIPIEELEDRVFVNCNTSIYHGSSLSNCRHTSSVEE

SEQ ID NO: 2939 - protein, 42 aa, Artificial Sequence; identical to SEQ ID NO: 2818
  chemically synthesized

SEQ ID NO: 2940 - protein, 42 aa, Artificial Sequence
  chemically synthesized
SQVSPFKIPIEELEDRVFVNCNTSIYRGTSLSNCRHTSSVEE

SEQ ID NO: 2941 - protein, 42 aa, Artificial Sequence
  chemically synthesized
SQVSPFKIPIEELEDRVFVNCNTSIYRGYSLSNCRHTSSVEE

SEQ ID NO: 2942 - protein, 42 aa, Artificial Sequence
  chemically synthesized
SQVSPFKIPIEELEDRVFVNCNTSIYRGSTLSNCRHTSSVEE

SEQ ID NO: 2943 - protein, 42 aa, Artificial Sequence
  chemically synthesized
SQVSPFKIPIEELEDRVFVNCNTSIYRGSYLSNCRHTSSVEE

SEQ ID NO: 2944 - protein, 42 aa, Artificial Sequence
  chemically synthesized
SQVSPFKIPIEELEDRVFVNCNTSIYRGSSISNCRHTSSVEE

SEQ ID NO: 2945 - protein, 42 aa, Artificial Sequence
  chemically synthesized
SQVSPFKIPIEELEDRVFVNCNTSIYRGSSVSNCRHTSSVEE

SEQ ID NO: 2946 - protein, 42 aa, Artificial Sequence
  chemically synthesized
SQVSPFKIPIEELEDRVFVNCNTSIYRGSSFSNCRHTSSVEE

SEQ ID NO: 2947 - protein, 42 aa, Artificial Sequence
  chemically synthesized
SQVSPFKIPIEELEDRVFVNCNTSIYRGSSMSNCRHTSSVEE

SEQ ID NO: 2948 - protein, 42 aa, Artificial Sequence
  chemically synthesized
SQVSPFKIPIEELEDRVFVNCNTSIYRGSSHSNCRHTSSVEE

SEQ ID NO: 2949 - protein, 42 aa, Artificial Sequence
  chemically synthesized
SQVSPFKIPIEELEDRVFVNCNTSIYRGSSLTNCRHTSSVEE

SEQ ID NO: 2950 - protein, 42 aa, Artificial Sequence
  chemically synthesized
SQVSPFKIPIEELEDRVFVNCNTSIYRGSSLYNCRHTSSVEE

SEQ ID NO: 2951 - protein, 42 aa, Artificial Sequence
  chemically synthesized
SQVSPFKIPIEELEDRVFVNCNTSIYRGSSLSQCRHTSSVEE

SEQ ID NO: 2952 - protein, 42 aa, Artificial Sequence
  chemically synthesized
SQVSPFKIPIEELEDRVFVNCNTSIYRGSSLSNSRHTSSVEE

SEQ ID NO: 2953 - protein, 42 aa, Artificial Sequence
  chemically synthesized
SQVSPFKIPIEELEDRVFVNCNTSIYRGSSLSNGRHTSSVEE

SEQ ID NO: 2954 - protein, 42 aa, Artificial Sequence; identical to SEQ ID NO: 2953
  chemically synthesized

SEQ ID NO: 2955 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRGSSLSNCXHTSSVEE

SEQ ID NO: 2956 - protein, 42 aa, Artificial Sequence
  chemically synthesized
SQVSPFKIPIEELEDRVFVNCNTSIYRGSSLSNCHHTSSVEE

SEQ ID NO: 2957 - protein, 42 aa, Artificial Sequence
  chemically synthesized
SQVSPFKIPIEELEDRVFVNCNTSIYRGSSLSNCKHTSSVEE

SEQ ID NO: 2958 - protein, 42 aa, Artificial Sequence
  chemically synthesized
SQVSPFKIPIEELEDRVFVNCNTSIYRGSSLSNCRGTSSVEE

SEQ ID NO: 2959 - protein, 42 aa, Artificial Sequence; identical to SEQ ID NO: 2958
  chemically synthesized

SEQ ID NO: 2960 - protein, 42 aa, Artificial Sequence
  chemically synthesized
SQVSPFKIPIEELEDRVFVNCNTSIYRGSSLSNCRITSSVEE

SEQ ID NO: 2961 - protein, 42 aa, Artificial Sequence
  chemically synthesized
SQVSPFKIPIEELEDRVFVNCNTSIYRGSSLSNCRLTSSVEE

SEQ ID NO: 2962 - protein, 42 aa, Artificial Sequence
  chemically synthesized
SQVSPFKIPIEELEDRVFVNCNTSIYRGSSLSNCRMTSSVEE

SEQ ID NO: 2963 - protein, 42 aa, Artificial Sequence
  chemically synthesized
SQVSPFKIPIEELEDRVFVNCNTSIYRGSSLSNCRVTSSVEE

SEQ ID NO: 2964 - protein, 42 aa, Artificial Sequence
  chemically synthesized
SQVSPFKIPIEELEDRVFVNCNTSIYRGSSLSNCRHSSSVEE

SEQ ID NO: 2965 - protein, 42 aa, Artificial Sequence
  chemically synthesized
SQVSPFKIPIEELEDRVFVNCNTSIYRGSSLSNCRHYSSVEE

SEQ ID NO: 2966 - protein, 42 aa, Artificial Sequence
  chemically synthesized
SQVSPFKIPIEELEDRVFVNCNTSIYRGSSLSNCRHTTSVEE

SEQ ID NO: 2967 - protein, 42 aa, Artificial Sequence
  chemically synthesized
SQVSPFKIPIEELEDRVFVNCNTSIYRGSSLSNCRHTYSVEE

SEQ ID NO: 2968 - protein, 42 aa, Artificial Sequence
  chemically synthesized
SQVSPFKIPIEELEDRVFVNCNTSIYRGSSLSNCRHTSTVEE

SEQ ID NO: 2969 - protein, 42 aa, Artificial Sequence
  chemically synthesized
SQVSPFKIPIEELEDRVFVNCNTSIYRGSSLSNCRHTSYVEE

SEQ ID NO: 2970 - protein, 42 aa, Artificial Sequence
  chemically synthesized
SQVSPFKIPIEELEDRVFVNCNTSIYRGSSLSNCRHTSSIEE

SEQ ID NO: 2971 - protein, 42 aa, Artificial Sequence
  chemically synthesized
SQVSPFKIPIEELEDRVFVNCNTSIYRGSSLSNCRHTSSLEE

SEQ ID NO: 2972 - protein, 42 aa, Artificial Sequence
  chemically synthesized
SQVSPFKIPIEELEDRVFVNCNTSIYRGSSLSNCRHTSSFEE

SEQ ID NO: 2973 - protein, 42 aa, Artificial Sequence
  chemically synthesized
SQVSPFKIPIEELEDRVFVNCNTSIYRGSSLSNCRHTSSHEE

SEQ ID NO: 2974 - protein, 42 aa, Artificial Sequence
  chemically synthesized
SQVSPFKIPIEELEDRVFVNCNTSIYRGSSLSNCRHTSSMEE

SEQ ID NO: 2975 - protein, 42 aa, Artificial Sequence
  chemically synthesized
SQVSPFKIPIEELEDRVFVNCNTSIYRGSSLSNCRHTSSVDE

SEQ ID NO: 2976 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRGSSLSNCRHTSSVXE

SEQ ID NO: 2977 - protein, 42 aa, Artificial Sequence
  chemically synthesized
SQVSPFKIPIEELEDRVFVNCNTSIYRGSSLSNCRHTSSVED

SEQ ID NO: 2978 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRGSSLSNCRHTSSVEX

SEQ ID NO: 2979 - protein, 42 aa, Artificial Sequence
  chemically synthesized
SQVSGFKIPIEELEDRVFVNCNTSIYRGSSLSNCRHTSSVEE

SEQ ID NO: 2980 - protein, 42 aa, Artificial Sequence; identical to SEQ ID NO: 2979
  chemically synthesized

SEQ ID NO: 2981 - protein, 42 aa, Artificial Sequence
  chemically synthesized
SQVSPFKIGIEELEDRVFVNCNTSIYRGSSLSNCRHTSSVEE

SEQ ID NO: 2982 - protein, 42 aa, Artificial Sequence; identical to SEQ ID NO: 2981
  chemically synthesized

SEQ ID NO: 2983 - protein, 42 aa, Artificial Sequence; identical to SEQ ID NO: 83
  chemically synthesized

SEQ ID NO: 2984 - protein, 42 aa, Artificial Sequence; identical to SEQ ID NO: 202
  chemically synthesized

SEQ ID NO: 2985 - protein, 42 aa, Artificial Sequence
  chemically synthesized
YQVSPFKIPIEELEDRVFVNCNTSIYRATSLSNCRHTSSVEE

SEQ ID NO: 2986 - protein, 42 aa, Artificial Sequence; identical to SEQ ID NO: 322
  chemically synthesized

SEQ ID NO: 2987 - protein, 42 aa, Artificial Sequence; identical to SEQ ID NO: 440
  chemically synthesized

SEQ ID NO: 2988 - protein, 42 aa, Artificial Sequence
  chemically synthesized
SQISPFKIPIEELEDRVFVNCNTSIYRATSLSNCRHTSSVEE

SEQ ID NO: 2989 - protein, 42 aa, Artificial Sequence
  chemically synthesized
SQPSPFKIPIEELEDRVFVNCNTSIYRATSLSNCRHTSSVEE

SEQ ID NO: 2990 - protein, 42 aa, Artificial Sequence
  chemically synthesized
SQFSPFKIPIEELEDRVFVNCNTSIYRATSLSNCRHTSSVEE

SEQ ID NO: 2991 - protein, 42 aa, Artificial Sequence; identical to SEQ ID NO: 559
  chemically synthesized

SEQ ID NO: 2992 - protein, 42 aa, Artificial Sequence
  chemically synthesized
SQVYPFKIPIEELEDRVFVNCNTSIYRATSLSNCRHTSSVEE

SEQ ID NO: 2993 - protein, 42 aa, Artificial Sequence
  chemically synthesized
SQVSPWKIPIEELEDRVFVNCNTSIYRATSLSNCRHTSSVEE

SEQ ID NO: 2994 - protein, 42 aa, Artificial Sequence
  chemically synthesized
SQVSPYKIPIEELEDRVFVNCNTSIYRATSLSNCRHTSSVEE

SEQ ID NO: 2995 - protein, 42 aa, Artificial Sequence
  chemically synthesized
SQVSPHKIPIEELEDRVFVNCNTSIYRATSLSNCRHTSSVEE

SEQ ID NO: 2996 - protein, 42 aa, Artificial Sequence
  chemically synthesized
SQVSPFRIPIEELEDRVFVNCNTSIYRATSLSNCRHTSSVEE

SEQ ID NO: 2997 - protein, 42 aa, Artificial Sequence
  chemically synthesized
SQVSPFHIPIEELEDRVFVNCNTSIYRATSLSNCRHTSSVEE

SEQ ID NO: 2998 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRATSLSNCRHTSSVEE

SEQ ID NO: 2999 - protein, 42 aa, Artificial Sequence; identical to SEQ ID NO: 798
  chemically synthesized

SEQ ID NO: 3000 - protein, 42 aa, Artificial Sequence
  chemically synthesized
SQVSPFKHPIEELEDRVFVNCNTSIYRATSLSNCRHTSSVEE

SEQ ID NO: 3001 - protein, 42 aa, Artificial Sequence
  chemically synthesized
SQVSPFKVPIEELEDRVFVNCNTSIYRATSLSNCRHTSSVEE

SEQ ID NO: 3002 - protein, 42 aa, Artificial Sequence
  chemically synthesized
SQVSPFKFPIEELEDRVFVNCNTSIYRATSLSNCRHTSSVEE

SEQ ID NO: 3003 - protein, 42 aa, Artificial Sequence
  chemically synthesized
SQVSPFKMPIEELEDRVFVNCNTSIYRATSLSNCRHTSSVEE

SEQ ID NO: 3004 - protein, 42 aa, Artificial Sequence; identical to SEQ ID NO: 916
  chemically synthesized

SEQ ID NO: 3005 - protein, 42 aa, Artificial Sequence
  chemically synthesized
SQVSPFKIPHEELEDRVFVNCNTSIYRATSLSNCRHTSSVEE

SEQ ID NO: 3006 - protein, 42 aa, Artificial Sequence
  chemically synthesized
SQVSPFKIPVEELEDRVFVNCNTSIYRATSLSNCRHTSSVEE

SEQ ID NO: 3007 - protein, 42 aa, Artificial Sequence
  chemically synthesized
SQVSPFKIPFEELEDRVFVNCNTSIYRATSLSNCRHTSSVEE

SEQ ID NO: 3008 - protein, 42 aa, Artificial Sequence
  chemically synthesized
SQVSPFKIPMEELEDRVFVNCNTSIYRATSLSNCRHTSSVEE

SEQ ID NO: 3009 - protein, 42 aa, Artificial Sequence; identical to SEQ ID NO: 1036
  chemically synthesized

SEQ ID NO: 3010 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRATSLSNCRHTSSVEE

SEQ ID NO: 3011 - protein, 42 aa, Artificial Sequence; identical to SEQ ID NO: 1156
  chemically synthesized

SEQ ID NO: 3012 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRATSLSNCRHTSSVEE

SEQ ID NO: 3013 - protein, 42 aa, Artificial Sequence
  chemically synthesized
SQVSPFKIPIEEVEDRVFVNCNTSIYRATSLSNCRHTSSVEE

SEQ ID NO: 3014 - protein, 42 aa, Artificial Sequence; identical to SEQ ID NO: 1273
  chemically synthesized

SEQ ID NO: 3015 - protein, 42 aa, Artificial Sequence
  chemically synthesized
SQVSPFKIPIEEFEDRVFVNCNTSIYRATSLSNCRHTSSVEE

SEQ ID NO: 3016 - protein, 42 aa, Artificial Sequence
  chemically synthesized
SQVSPFKIPIEEHEDRVFVNCNTSIYRATSLSNCRHTSSVEE

SEQ ID NO: 3017 - protein, 42 aa, Artificial Sequence
  chemically synthesized
SQVSPFKIPIEEMEDRVFVNCNTSIYRATSLSNCRHTSSVEE

SEQ ID NO: 3018 - protein, 42 aa, Artificial Sequence; identical to SEQ ID NO: 1393
  chemically synthesized

SEQ ID NO: 3019 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRATSLSNCRHTSSVEE

SEQ ID NO: 3020 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRATSLSNCRHTSSVEE

SEQ ID NO: 3021 - protein, 42 aa, Artificial Sequence
  chemically synthesized
SQVSPFKIPIEELEERVFVNCNTSIYRATSLSNCRHTSSVEE

SEQ ID NO: 3022 - protein, 42 aa, Artificial Sequence; identical to SEQ ID NO: 1512
  chemically synthesized

SEQ ID NO: 3023 - protein, 42 aa, Artificial Sequence
  chemically synthesized
SQVSPFKIPIEELEDHVFVNCNTSIYRATSLSNCRHTSSVEE

SEQ ID NO: 3024 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRATSLSNCRHTSSVEE

SEQ ID NO: 3025 - protein, 42 aa, Artificial Sequence; identical to SEQ ID NO: 1629
  chemically synthesized

SEQ ID NO: 3026 - protein, 42 aa, Artificial Sequence
  chemically synthesized
SQVSPFKIPIEELEDRLFVNCNTSIYRATSLSNCRHTSSVEE

SEQ ID NO: 3027 - protein, 42 aa, Artificial Sequence
  chemically synthesized
SQVSPFKIPIEELEDRFFVNCNTSIYRATSLSNCRHTSSVEE

SEQ ID NO: 3028 - protein, 42 aa, Artificial Sequence
  chemically synthesized
SQVSPFKIPIEELEDRHFVNCNTSIYRATSLSNCRHTSSVEE

SEQ ID NO: 3029 - protein, 42 aa, Artificial Sequence
  chemically synthesized
SQVSPFKIPIEELEDRMFVNCNTSIYRATSLSNCRHTSSVEE

SEQ ID NO: 3030 - protein, 42 aa, Artificial Sequence; identical to SEQ ID NO: 1746
  chemically synthesized

SEQ ID NO: 3031 - protein, 42 aa, Artificial Sequence
  chemically synthesized
SQVSPFKIPIEELEDRVLVNCNTSIYRATSLSNCRHTSSVEE

SEQ ID NO: 3032 - protein, 42 aa, Artificial Sequence
  chemically synthesized
SQVSPFKIPIEELEDRVVVNCNTSIYRATSLSNCRHTSSVEE

SEQ ID NO: 3033 - protein, 42 aa, Artificial Sequence
  chemically synthesized
SQVSPFKIPIEELEDRVHVNCNTSIYRATSLSNCRHTSSVEE

SEQ ID NO: 3034 - protein, 42 aa, Artificial Sequence
  chemically synthesized
SQVSPFKIPIEELEDRVMVNCNTSIYRATSLSNCRHTSSVEE

SEQ ID NO: 3035 - protein, 42 aa, Artificial Sequence; identical to SEQ ID NO: 1863
  chemically synthesized

SEQ ID NO: 3036 - protein, 42 aa, Artificial Sequence
  chemically synthesized
SQVSPFKIPIEELEDRVFLNCNTSIYRATSLSNCRHTSSVEE

SEQ ID NO: 3037 - protein, 42 aa, Artificial Sequence
  chemically synthesized
SQVSPFKIPIEELEDRVFFNCNTSIYRATSLSNCRHTSSVEE

SEQ ID NO: 3038 - protein, 42 aa, Artificial Sequence
  chemically synthesized
SQVSPFKIPIEELEDRVFHNCNTSIYRATSLSNCRHTSSVEE

SEQ ID NO: 3039 - protein, 42 aa, Artificial Sequence
  chemically synthesized
SQVSPFKIPIEELEDRVFMNCNTSIYRATSLSNCRHTSSVEE

SEQ ID NO: 3040 - protein, 42 aa, Artificial Sequence; identical to SEQ ID NO: 1984
  chemically synthesized

SEQ ID NO: 3041 - protein, 42 aa, Artificial Sequence
  chemically synthesized
SQVSPFKIPIEELEDRVFVNSNTSIYRATSLSNCRHTSSVEE

SEQ ID NO: 3042 - protein, 42 aa, Artificial Sequence
  chemically synthesized
SQVSPFKIPIEELEDRVFVNGNTSIYRATSLSNCRHTSSVEE

SEQ ID NO: 3043 - protein, 42 aa, Artificial Sequence
  chemically synthesized
SQVSPFKIPIEELEDRVFVNANTSIYRATSLSNCRHTSSVEE

SEQ ID NO: 3044 - protein, 42 aa, Artificial Sequence; identical to SEQ ID NO: 2225
  chemically synthesized

SEQ ID NO: 3045 - protein, 42 aa, Artificial Sequence; identical to SEQ ID NO: 2345
  chemically synthesized

SEQ ID NO: 3046 - protein, 42 aa, Artificial Sequence
  chemically synthesized
SQVSPFKIPIEELEDRVFVNCNYSIYRATSLSNCRHTSSVEE

SEQ ID NO: 3047 - protein, 42 aa, Artificial Sequence; identical to SEQ ID NO: 2465
  chemically synthesized

SEQ ID NO: 3048 - protein, 42 aa, Artificial Sequence
  chemically synthesized
SQVSPFKIPIEELEDRVFVNCNTYIYRATSLSNCRHTSSVEE

SEQ ID NO: 3049 - protein, 42 aa, Artificial Sequence
  chemically synthesized
SQVSPFKIPIEELEDRVFVNCNTSVYRATSLSNCRHTSSVEE

SEQ ID NO: 3050 - protein, 42 aa, Artificial Sequence; identical to SEQ ID NO: 2582
  chemically synthesized

SEQ ID NO: 3051 - protein, 42 aa, Artificial Sequence
  chemically synthesized
SQVSPFKIPIEELEDRVFVNCNTSHYRATSLSNCRHTSSVEE

SEQ ID NO: 3052 - protein, 42 aa, Artificial Sequence
  chemically synthesized
SQVSPFKIPIEELEDRVFVNCNTSFYRATSLSNCRHTSSVEE

SEQ ID NO: 3053 - protein, 42 aa, Artificial Sequence
  chemically synthesized
SQVSPFKIPIEELEDRVFVNCNTSMYRATSLSNCRHTSSVEE

SEQ ID NO: 3054 - protein, 42 aa, Artificial Sequence
  chemically synthesized
SQVSPFKIPIEELEDRVFVNCNTSIWRATSLSNCRHTSSVEE

SEQ ID NO: 3055 - protein, 42 aa, Artificial Sequence
  chemically synthesized
SQVSPFKIPIEELEDRVFVNCNTSIFRATSLSNCRHTSSVEE

SEQ ID NO: 3056 - protein, 42 aa, Artificial Sequence
  chemically synthesized
SQVSPFKIPIEELEDRVFVNCNTSISRATSLSNCRHTSSVEE

SEQ ID NO: 3057 - protein, 42 aa, Artificial Sequence; identical to SEQ ID NO: 2700
  chemically synthesized

SEQ ID NO: 3058 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXATSLSNCRHTSSVEE

SEQ ID NO: 3059 - protein, 42 aa, Artificial Sequence
  chemically synthesized
SQVSPFKIPIEELEDRVFVNCNTSIYHATSLSNCRHTSSVEE

SEQ ID NO: 3060 - protein, 42 aa, Artificial Sequence; identical to SEQ ID NO: 2819
  chemically synthesized

SEQ ID NO: 3061 - protein, 42 aa, Artificial Sequence; identical to SEQ ID NO: 2940
  chemically synthesized

SEQ ID NO: 3062 - protein, 42 aa, Artificial Sequence
  chemically synthesized
SQVSPFKIPIEELEDRVFVNCNTSIYRATTLSNCRHTSSVEE

SEQ ID NO: 3063 - protein, 42 aa, Artificial Sequence
  chemically synthesized
SQVSPFKIPIEELEDRVFVNCNTSIYRATYLSNCRHTSSVEE

SEQ ID NO: 3064 - protein, 42 aa, Artificial Sequence
  chemically synthesized
SQVSPFKIPIEELEDRVFVNCNTSIYRATSISNCRHTSSVEE

SEQ ID NO: 3065 - protein, 42 aa, Artificial Sequence
  chemically synthesized
SQVSPFKIPIEELEDRVFVNCNTSIYRATSVSNCRHTSSVEE

SEQ ID NO: 3066 - protein, 42 aa, Artificial Sequence
  chemically synthesized
SQVSPFKIPIEELEDRVFVNCNTSIYRATSFSNCRHTSSVEE

SEQ ID NO: 3067 - protein, 42 aa, Artificial Sequence
  chemically synthesized
SQVSPFKIPIEELEDRVFVNCNTSIYRATSMSNCRHTSSVEE

SEQ ID NO: 3068 - protein, 42 aa, Artificial Sequence
  chemically synthesized
SQVSPFKIPIEELEDRVFVNCNTSIYRATSHSNCRHTSSVEE

SEQ ID NO: 3069 - protein, 42 aa, Artificial Sequence
  chemically synthesized
SQVSPFKIPIEELEDRVFVNCNTSIYRATSLTNCRHTSSVEE

SEQ ID NO: 3070 - protein, 42 aa, Artificial Sequence
  chemically synthesized
SQVSPFKIPIEELEDRVFVNCNTSIYRATSLYNCRHTSSVEE

SEQ ID NO: 3071 - protein, 42 aa, Artificial Sequence
  chemically synthesized
SQVSPFKIPIEELEDRVFVNCNTSIYRATSLSQCRHTSSVEE

SEQ ID NO: 3072 - protein, 42 aa, Artificial Sequence
  chemically synthesized
SQVSPFKIPIEELEDRVFVNCNTSIYRATSLSNSRHTSSVEE

SEQ ID NO: 3073 - protein, 42 aa, Artificial Sequence
  chemically synthesized
SQVSPFKIPIEELEDRVFVNCNTSIYRATSLSNGRHTSSVEE

SEQ ID NO: 3074 - protein, 42 aa, Artificial Sequence
  chemically synthesized
SQVSPFKIPIEELEDRVFVNCNTSIYRATSLSNARHTSSVEE

SEQ ID NO: 3075 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRATSLSNCXHTSSVEE

SEQ ID NO: 3076 - protein, 42 aa, Artificial Sequence
  chemically synthesized
SQVSPFKIPIEELEDRVFVNCNTSIYRATSLSNCHHTSSVEE

SEQ ID NO: 3077 - protein, 42 aa, Artificial Sequence
  chemically synthesized
SQVSPFKIPIEELEDRVFVNCNTSIYRATSLSNCKHTSSVEE

SEQ ID NO: 3078 - protein, 42 aa, Artificial Sequence
  chemically synthesized
SQVSPFKIPIEELEDRVFVNCNTSIYRATSLSNCRGTSSVEE

SEQ ID NO: 3079 - protein, 42 aa, Artificial Sequence
  chemically synthesized
SQVSPFKIPIEELEDRVFVNCNTSIYRATSLSNCRATSSVEE

SEQ ID NO: 3080 - protein, 42 aa, Artificial Sequence
  chemically synthesized
SQVSPFKIPIEELEDRVFVNCNTSIYRATSLSNCRITSSVEE

SEQ ID NO: 3081 - protein, 42 aa, Artificial Sequence
  chemically synthesized
SQVSPFKIPIEELEDRVFVNCNTSIYRATSLSNCRLTSSVEE

SEQ ID NO: 3082 - protein, 42 aa, Artificial Sequence
  chemically synthesized
SQVSPFKIPIEELEDRVFVNCNTSIYRATSLSNCRMTSSVEE

SEQ ID NO: 3083 - protein, 42 aa, Artificial Sequence
  chemically synthesized
SQVSPFKIPIEELEDRVFVNCNTSIYRATSLSNCRVTSSVEE

SEQ ID NO: 3084 - protein, 42 aa, Artificial Sequence
  chemically synthesized
SQVSPFKIPIEELEDRVFVNCNTSIYRATSLSNCRHSSSVEE

SEQ ID NO: 3085 - protein, 42 aa, Artificial Sequence
  chemically synthesized
SQVSPFKIPIEELEDRVFVNCNTSIYRATSLSNCRHYSSVEE

SEQ ID NO: 3086 - protein, 42 aa, Artificial Sequence
  chemically synthesized
SQVSPFKIPIEELEDRVFVNCNTSIYRATSLSNCRHTTSVEE

SEQ ID NO: 3087 - protein, 42 aa, Artificial Sequence
  chemically synthesized
SQVSPFKIPIEELEDRVFVNCNTSIYRATSLSNCRHTYSVEE

SEQ ID NO: 3088 - protein, 42 aa, Artificial Sequence
  chemically synthesized
SQVSPFKIPIEELEDRVFVNCNTSIYRATSLSNCRHTSTVEE

SEQ ID NO: 3089 - protein, 42 aa, Artificial Sequence
  chemically synthesized
SQVSPFKIPIEELEDRVFVNCNTSIYRATSLSNCRHTSYVEE

SEQ ID NO: 3090 - protein, 42 aa, Artificial Sequence
  chemically synthesized
SQVSPFKIPIEELEDRVFVNCNTSIYRATSLSNCRHTSSIEE

SEQ ID NO: 3091 - protein, 42 aa, Artificial Sequence
  chemically synthesized
SQVSPFKIPIEELEDRVFVNCNTSIYRATSLSNCRHTSSLEE

SEQ ID NO: 3092 - protein, 42 aa, Artificial Sequence
  chemically synthesized
SQVSPFKIPIEELEDRVFVNCNTSIYRATSLSNCRHTSSFEE

SEQ ID NO: 3093 - protein, 42 aa, Artificial Sequence
  chemically synthesized
SQVSPFKIPIEELEDRVFVNCNTSIYRATSLSNCRHTSSHEE

SEQ ID NO: 3094 - protein, 42 aa, Artificial Sequence
  chemically synthesized
SQVSPFKIPIEELEDRVFVNCNTSIYRATSLSNCRHTSSMEE

SEQ ID NO: 3095 - protein, 42 aa, Artificial Sequence
  chemically synthesized
SQVSPFKIPIEELEDRVFVNCNTSIYRATSLSNCRHTSSVDE

SEQ ID NO: 3096 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRATSLSNCRHTSSVXE

SEQ ID NO: 3097 - protein, 42 aa, Artificial Sequence
  chemically synthesized
SQVSPFKIPIEELEDRVFVNCNTSIYRATSLSNCRHTSSVED

SEQ ID NO: 3098 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRATSLSNCRHTSSVEX

SEQ ID NO: 3099 - protein, 42 aa, Artificial Sequence
  chemically synthesized
SQVSAFKIPIEELEDRVFVNCNTSIYRATSLSNCRHTSSVEE

SEQ ID NO: 3100 - protein, 42 aa, Artificial Sequence
  chemically synthesized
SQVSGFKIPIEELEDRVFVNCNTSIYRATSLSNCRHTSSVEE

SEQ ID NO: 3101 - protein, 42 aa, Artificial Sequence
  chemically synthesized
SQVSPFKIAIEELEDRVFVNCNTSIYRATSLSNCRHTSSVEE

SEQ ID NO: 3102 - protein, 42 aa, Artificial Sequence
  chemically synthesized
SQVSPFKIGIEELEDRVFVNCNTSIYRATSLSNCRHTSSVEE

SEQ ID NO: 3103 - protein, 42 aa, Artificial Sequence; identical to SEQ ID NO: 85
  chemically synthesized

SEQ ID NO: 3104 - protein, 42 aa, Artificial Sequence; identical to SEQ ID NO: 204
  chemically synthesized

SEQ ID NO: 3105 - protein, 42 aa, Artificial Sequence
  chemically synthesized
YQVSPFKIPIEELEDRVFVNCNTSIYRASTLSNCRHTSSVEE

SEQ ID NO: 3106 - protein, 42 aa, Artificial Sequence; identical to SEQ ID NO: 324
  chemically synthesized

SEQ ID NO: 3107 - protein, 42 aa, Artificial Sequence; identical to SEQ ID NO: 442
  chemically synthesized

SEQ ID NO: 3108 - protein, 42 aa, Artificial Sequence
  chemically synthesized
SQISPFKIPIEELEDRVFVNCNTSIYRASTLSNCRHTSSVEE

SEQ ID NO: 3109 - protein, 42 aa, Artificial Sequence
  chemically synthesized
SQPSPFKIPIEELEDRVFVNCNTSIYRASTLSNCRHTSSVEE

SEQ ID NO: 3110 - protein, 42 aa, Artificial Sequence
  chemically synthesized
SQFSPFKIPIEELEDRVFVNCNTSIYRASTLSNCRHTSSVEE

SEQ ID NO: 3111 - protein, 42 aa, Artificial Sequence; identical to SEQ ID NO: 561
  chemically synthesized

SEQ ID NO: 3112 - protein, 42 aa, Artificial Sequence
  chemically synthesized
SQVYPFKIPIEELEDRVFVNCNTSIYRASTLSNCRHTSSVEE

SEQ ID NO: 3113 - protein, 42 aa, Artificial Sequence
  chemically synthesized
SQVSPWKIPIEELEDRVFVNCNTSIYRASTLSNCRHTSSVEE

SEQ ID NO: 3114 - protein, 42 aa, Artificial Sequence
  chemically synthesized
SQVSPYKIPIEELEDRVFVNCNTSIYRASTLSNCRHTSSVEE

SEQ ID NO: 3115 - protein, 42 aa, Artificial Sequence
  chemically synthesized
SQVSPHKIPIEELEDRVFVNCNTSIYRASTLSNCRHTSSVEE

SEQ ID NO: 3116 - protein, 42 aa, Artificial Sequence
  chemically synthesized
SQVSPFRIPIEELEDRVFVNCNTSIYRASTLSNCRHTSSVEE

SEQ ID NO: 3117 - protein, 42 aa, Artificial Sequence
  chemically synthesized
SQVSPFHIPIEELEDRVFVNCNTSIYRASTLSNCRHTSSVEE

SEQ ID NO: 3118 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASTLSNCRHTSSVEE

SEQ ID NO: 3119 - protein, 42 aa, Artificial Sequence; identical to SEQ ID NO: 800
  chemically synthesized

SEQ ID NO: 3120 - protein, 42 aa, Artificial Sequence
  chemically synthesized
SQVSPFKHPIEELEDRVFVNCNTSIYRASTLSNCRHTSSVEE

SEQ ID NO: 3121 - protein, 42 aa, Artificial Sequence
  chemically synthesized
SQVSPFKVPIEELEDRVFVNCNTSIYRASTLSNCRHTSSVEE

SEQ ID NO: 3122 - protein, 42 aa, Artificial Sequence
  chemically synthesized
SQVSPFKFPIEELEDRVFVNCNTSIYRASTLSNCRHTSSVEE

SEQ ID NO: 3123 - protein, 42 aa, Artificial Sequence
  chemically synthesized
SQVSPFKMPIEELEDRVFVNCNTSIYRASTLSNCRHTSSVEE

SEQ ID NO: 3124 - protein, 42 aa, Artificial Sequence; identical to SEQ ID NO: 918
  chemically synthesized

SEQ ID NO: 3125 - protein, 42 aa, Artificial Sequence
  chemically synthesized
SQVSPFKIPHEELEDRVFVNCNTSIYRASTLSNCRHTSSVEE

SEQ ID NO: 3126 - protein, 42 aa, Artificial Sequence
  chemically synthesized
SQVSPFKIPVEELEDRVFVNCNTSIYRASTLSNCRHTSSVEE

SEQ ID NO: 3127 - protein, 42 aa, Artificial Sequence
  chemically synthesized
SQVSPFKIPFEELEDRVFVNCNTSIYRASTLSNCRHTSSVEE

SEQ ID NO: 3128 - protein, 42 aa, Artificial Sequence
  chemically synthesized
SQVSPFKIPMEELEDRVFVNCNTSIYRASTLSNCRHTSSVEE

SEQ ID NO: 3129 - protein, 42 aa, Artificial Sequence; identical to SEQ ID NO: 1038
  chemically synthesized

SEQ ID NO: 3130 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASTLSNCRHTSSVEE

SEQ ID NO: 3131 - protein, 42 aa, Artificial Sequence; identical to SEQ ID NO: 1158
  chemically synthesized

SEQ ID NO: 3132 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASTLSNCRHTSSVEE

SEQ ID NO: 3133 - protein, 42 aa, Artificial Sequence
  chemically synthesized
SQVSPFKIPIEEVEDRVFVNCNTSIYRASTLSNCRHTSSVEE

SEQ ID NO: 3134 - protein, 42 aa, Artificial Sequence; identical to SEQ ID NO: 1275
  chemically synthesized

SEQ ID NO: 3135 - protein, 42 aa, Artificial Sequence
  chemically synthesized
SQVSPFKIPIEEFEDRVFVNCNTSIYRASTLSNCRHTSSVEE

SEQ ID NO: 3136 - protein, 42 aa, Artificial Sequence
  chemically synthesized
SQVSPFKIPIEEHEDRVFVNCNTSIYRASTLSNCRHTSSVEE

SEQ ID NO: 3137 - protein, 42 aa, Artificial Sequence
  chemically synthesized
SQVSPFKIPIEEMEDRVFVNCNTSIYRASTLSNCRHTSSVEE

SEQ ID NO: 3138 - protein, 42 aa, Artificial Sequence; identical to SEQ ID NO: 1395
  chemically synthesized

SEQ ID NO: 3139 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASTLSNCRHTSSVEE

SEQ ID NO: 3140 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASTLSNCRHTSSVEE

SEQ ID NO: 3141 - protein, 42 aa, Artificial Sequence
  chemically synthesized
SQVSPFKIPIEELEERVFVNCNTSIYRASTLSNCRHTSSVEE

SEQ ID NO: 3142 - protein, 42 aa, Artificial Sequence; identical to SEQ ID NO: 1514
  chemically synthesized

SEQ ID NO: 3143 - protein, 42 aa, Artificial Sequence
  chemically synthesized
SQVSPFKIPIEELEDHVFVNCNTSIYRASTLSNCRHTSSVEE

SEQ ID NO: 3144 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASTLSNCRHTSSVEE

SEQ ID NO: 3145 - protein, 42 aa, Artificial Sequence; identical to SEQ ID NO: 1631
  chemically synthesized

SEQ ID NO: 3146 - protein, 42 aa, Artificial Sequence
  chemically synthesized
SQVSPFKIPIEELEDRLFVNCNTSIYRASTLSNCRHTSSVEE

SEQ ID NO: 3147 - protein, 42 aa, Artificial Sequence
  chemically synthesized
SQVSPFKIPIEELEDRFFVNCNTSIYRASTLSNCRHTSSVEE

SEQ ID NO: 3148 - protein, 42 aa, Artificial Sequence
  chemically synthesized
SQVSPFKIPIEELEDRHFVNCNTSIYRASTLSNCRHTSSVEE

SEQ ID NO: 3149 - protein, 42 aa, Artificial Sequence
  chemically synthesized
SQVSPFKIPIEELEDRMFVNCNTSIYRASTLSNCRHTSSVEE

SEQ ID NO: 3150 - protein, 42 aa, Artificial Sequence; identical to SEQ ID NO: 1748
  chemically synthesized

SEQ ID NO: 3151 - protein, 42 aa, Artificial Sequence
  chemically synthesized
SQVSPFKIPIEELEDRVLVNCNTSIYRASTLSNCRHTSSVEE

SEQ ID NO: 3152 - protein, 42 aa, Artificial Sequence
  chemically synthesized
SQVSPFKIPIEELEDRVVVNCNTSIYRASTLSNCRHTSSVEE

SEQ ID NO: 3153 - protein, 42 aa, Artificial Sequence
  chemically synthesized
SQVSPFKIPIEELEDRVHVNCNTSIYRASTLSNCRHTSSVEE

SEQ ID NO: 3154 - protein, 42 aa, Artificial Sequence
  chemically synthesized
SQVSPFKIPIEELEDRVMVNCNTSIYRASTLSNCRHTSSVEE

SEQ ID NO: 3155 - protein, 42 aa, Artificial Sequence; identical to SEQ ID NO: 1865
  chemically synthesized

SEQ ID NO: 3156 - protein, 42 aa, Artificial Sequence
  chemically synthesized
SQVSPFKIPIEELEDRVFLNCNTSIYRASTLSNCRHTSSVEE

SEQ ID NO: 3157 - protein, 42 aa, Artificial Sequence
  chemically synthesized
SQVSPFKIPIEELEDRVFFNCNTSIYRASTLSNCRHTSSVEE

SEQ ID NO: 3158 - protein, 42 aa, Artificial Sequence
  chemically synthesized
SQVSPFKIPIEELEDRVFHNCNTSIYRASTLSNCRHTSSVEE

SEQ ID NO: 3159 - protein, 42 aa, Artificial Sequence
  chemically synthesized
SQVSPFKIPIEELEDRVFMNCNTSIYRASTLSNCRHTSSVEE

SEQ ID NO: 3160 - protein, 42 aa, Artificial Sequence; identical to SEQ ID NO: 1986
  chemically synthesized

SEQ ID NO: 3161 - protein, 42 aa, Artificial Sequence
  chemically synthesized
SQVSPFKIPIEELEDRVFVNSNTSIYRASTLSNCRHTSSVEE

SEQ ID NO: 3162 - protein, 42 aa, Artificial Sequence
  chemically synthesized
SQVSPFKIPIEELEDRVFVNGNTSIYRASTLSNCRHTSSVEE

SEQ ID NO: 3163 - protein, 42 aa, Artificial Sequence
  chemically synthesized
SQVSPFKIPIEELEDRVFVNANTSIYRASTLSNCRHTSSVEE

SEQ ID NO: 3164 - protein, 42 aa, Artificial Sequence; identical to SEQ ID NO: 2227
  chemically synthesized

SEQ ID NO: 3165 - protein, 42 aa, Artificial Sequence; identical to SEQ ID NO: 2347
  chemically synthesized

SEQ ID NO: 3166 - protein, 42 aa, Artificial Sequence
  chemically synthesized
SQVSPFKIPIEELEDRVFVNCNYSIYRASTLSNCRHTSSVEE

SEQ ID NO: 3167 - protein, 42 aa, Artificial Sequence; identical to SEQ ID NO: 2467
  chemically synthesized

SEQ ID NO: 3168 - protein, 42 aa, Artificial Sequence
  chemically synthesized
SQVSPFKIPIEELEDRVFVNCNTYIYRASTLSNCRHTSSVEE

SEQ ID NO: 3169 - protein, 42 aa, Artificial Sequence
  chemically synthesized
SQVSPFKIPIEELEDRVFVNCNTSVYRASTLSNCRHTSSVEE

SEQ ID NO: 3170 - protein, 42 aa, Artificial Sequence; identical to SEQ ID NO: 2584
  chemically synthesized

SEQ ID NO: 3171 - protein, 42 aa, Artificial Sequence
  chemically synthesized
SQVSPFKIPIEELEDRVFVNCNTSHYRASTLSNCRHTSSVEE

SEQ ID NO: 3172 - protein, 42 aa, Artificial Sequence
  chemically synthesized
SQVSPFKIPIEELEDRVFVNCNTSFYRASTLSNCRHTSSVEE

SEQ ID NO: 3173 - protein, 42 aa, Artificial Sequence
  chemically synthesized
SQVSPFKIPIEELEDRVFVNCNTSMYRASTLSNCRHTSSVEE

SEQ ID NO: 3174 - protein, 42 aa, Artificial Sequence
  chemically synthesized
SQVSPFKIPIEELEDRVFVNCNTSIWRASTLSNCRHTSSVEE

SEQ ID NO: 3175 - protein, 42 aa, Artificial Sequence
  chemically synthesized
SQVSPFKIPIEELEDRVFVNCNTSIFRASTLSNCRHTSSVEE

SEQ ID NO: 3176 - protein, 42 aa, Artificial Sequence
  chemically synthesized
SQVSPFKIPIEELEDRVFVNCNTSISRASTLSNCRHTSSVEE

SEQ ID NO: 3177 - protein, 42 aa, Artificial Sequence; identical to SEQ ID NO: 2702
  chemically synthesized

SEQ ID NO: 3178 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASTLSNCRHTSSVEE

SEQ ID NO: 3179 - protein, 42 aa, Artificial Sequence
  chemically synthesized
SQVSPFKIPIEELEDRVFVNCNTSIYHASTLSNCRHTSSVEE

SEQ ID NO: 3180 - protein, 42 aa, Artificial Sequence; identical to SEQ ID NO: 2821
  chemically synthesized

SEQ ID NO: 3181 - protein, 42 aa, Artificial Sequence; identical to SEQ ID NO: 2942
  chemically synthesized

SEQ ID NO: 3182 - protein, 42 aa, Artificial Sequence; identical to SEQ ID NO: 3062
  chemically synthesized

SEQ ID NO: 3183 - protein, 42 aa, Artificial Sequence
  chemically synthesized
SQVSPFKIPIEELEDRVFVNCNTSIYRAYTLSNCRHTSSVEE

SEQ ID NO: 3184 - protein, 42 aa, Artificial Sequence
  chemically synthesized
SQVSPFKIPIEELEDRVFVNCNTSIYRASTISNCRHTSSVEE

SEQ ID NO: 3185 - protein, 42 aa, Artificial Sequence
  chemically synthesized
SQVSPFKIPIEELEDRVFVNCNTSIYRASTVSNCRHTSSVEE

SEQ ID NO: 3186 - protein, 42 aa, Artificial Sequence
  chemically synthesized
SQVSPFKIPIEELEDRVFVNCNTSIYRASTFSNCRHTSSVEE

SEQ ID NO: 3187 - protein, 42 aa, Artificial Sequence
  chemically synthesized
SQVSPFKIPIEELEDRVFVNCNTSIYRASTMSNCRHTSSVEE

SEQ ID NO: 3188 - protein, 42 aa, Artificial Sequence
  chemically synthesized
SQVSPFKIPIEELEDRVFVNCNTSIYRASTHSNCRHTSSVEE

SEQ ID NO: 3189 - protein, 42 aa, Artificial Sequence
  chemically synthesized
SQVSPFKIPIEELEDRVFVNCNTSIYRASTLTNCRHTSSVEE

SEQ ID NO: 3190 - protein, 42 aa, Artificial Sequence
  chemically synthesized
SQVSPFKIPIEELEDRVFVNCNTSIYRASTLYNCRHTSSVEE

SEQ ID NO: 3191 - protein, 42 aa, Artificial Sequence
  chemically synthesized
  MISC_FEATURE: synthetic
SQVSPFKIPIEELEDRVFVNCNTSIYRASTLSQCRHTSSVEE

SEQ ID NO: 3192 - protein, 42 aa, Artificial Sequence
  chemically synthesized
SQVSPFKIPIEELEDRVFVNCNTSIYRASTLSNSRHTSSVEE

SEQ ID NO: 3193 - protein, 42 aa, Artificial Sequence
  chemically synthesized
SQVSPFKIPIEELEDRVFVNCNTSIYRASTLSNGRHTSSVEE

SEQ ID NO: 3194 - protein, 42 aa, Artificial Sequence
  chemically synthesized
SQVSPFKIPIEELEDRVFVNCNTSIYRASTLSNARHTSSVEE

SEQ ID NO: 3195 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRASTLSNCXHTSSVEE

SEQ ID NO: 3196 - protein, 42 aa, Artificial Sequence
  chemically synthesized
SQVSPFKIPIEELEDRVFVNCNTSIYRASTLSNCHHTSSVEE

SEQ ID NO: 3197 - protein, 42 aa, Artificial Sequence
  chemically synthesized
SQVSPFKIPIEELEDRVFVNCNTSIYRASTLSNCKHTSSVEE

SEQ ID NO: 3198 - protein, 42 aa, Artificial Sequence
  chemically synthesized
SQVSPFKIPIEELEDRVFVNCNTSIYRASTLSNCRGTSSVEE

SEQ ID NO: 3199 - protein, 42 aa, Artificial Sequence
  chemically synthesized
SQVSPFKIPIEELEDRVFVNCNTSIYRASTLSNCRATSSVEE

SEQ ID NO: 3200 - protein, 42 aa, Artificial Sequence
  chemically synthesized
SQVSPFKIPIEELEDRVFVNCNTSIYRASTLSNCRITSSVEE

SEQ ID NO: 3201 - protein, 42 aa, Artificial Sequence
  chemically synthesized
SQVSPFKIPIEELEDRVFVNCNTSIYRASTLSNCRLTSSVEE

SEQ ID NO: 3202 - protein, 42 aa, Artificial Sequence
  chemically synthesized
SQVSPFKIPIEELEDRVFVNCNTSIYRASTLSNCRMTSSVEE

SEQ ID NO: 3203 - protein, 42 aa, Artificial Sequence
  chemically synthesized
SQVSPFKIPIEELEDRVFVNCNTSIYRASTLSNCRVTSSVEE

SEQ ID NO: 3204 - protein, 42 aa, Artificial Sequence
  chemically synthesized
SQVSPFKIPIEELEDRVFVNCNTSIYRASTLSNCRHSSSVEE

SEQ ID NO: 3205 - protein, 42 aa, Artificial Sequence
  chemically synthesized
SQVSPFKIPIEELEDRVFVNCNTSIYRASTLSNCRHYSSVEE

SEQ ID NO: 3206 - protein, 42 aa, Artificial Sequence
  chemically synthesized
SQVSPFKIPIEELEDRVFVNCNTSIYRASTLSNCRHTTSVEE

SEQ ID NO: 3207 - protein, 42 aa, Artificial Sequence
  chemically synthesized
SQVSPFKIPIEELEDRVFVNCNTSIYRASTLSNCRHTYSVEE

SEQ ID NO: 3208 - protein, 42 aa, Artificial Sequence
  chemically synthesized
SQVSPFKIPIEELEDRVFVNCNTSIYRASTLSNCRHTSTVEE

SEQ ID NO: 3209 - protein, 42 aa, Artificial Sequence
  chemically synthesized
SQVSPFKIPIEELEDRVFVNCNTSIYRASTLSNCRHTSYVEE

SEQ ID NO: 3210 - protein, 42 aa, Artificial Sequence
  chemically synthesized
SQVSPFKIPIEELEDRVFVNCNTSIYRASTLSNCRHTSSIEE

SEQ ID NO: 3211 - protein, 42 aa, Artificial Sequence
  chemically synthesized
SQVSPFKIPIEELEDRVFVNCNTSIYRASTLSNCRHTSSLEE

SEQ ID NO: 3212 - protein, 42 aa, Artificial Sequence
  chemically synthesized
SQVSPFKIPIEELEDRVFVNCNTSIYRASTLSNCRHTSSFEE

SEQ ID NO: 3213 - protein, 42 aa, Artificial Sequence
  chemically synthesized
SQVSPFKIPIEELEDRVFVNCNTSIYRASTLSNCRHTSSHEE

SEQ ID NO: 3214 - protein, 42 aa, Artificial Sequence
  chemically synthesized
SQVSPFKIPIEELEDRVFVNCNTSIYRASTLSNCRHTSSMEE

SEQ ID NO: 3215 - protein, 42 aa, Artificial Sequence
  chemically synthesized
SQVSPFKIPIEELEDRVFVNCNTSIYRASTLSNCRHTSSVDE

SEQ ID NO: 3216 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASTLSNCRHTSSVXE

SEQ ID NO: 3217 - protein, 42 aa, Artificial Sequence
  chemically synthesized
SQVSPFKIPIEELEDRVFVNCNTSIYRASTLSNCRHTSSVED

SEQ ID NO: 3218 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASTLSNCRHTSSVEX

SEQ ID NO: 3219 - protein, 42 aa, Artificial Sequence
  chemically synthesized
SQVSAFKIPIEELEDRVFVNCNTSIYRASTLSNCRHTSSVEE

SEQ ID NO: 3220 - protein, 42 aa, Artificial Sequence
  chemically synthesized
SQVSGFKIPIEELEDRVFVNCNTSIYRASTLSNCRHTSSVEE

SEQ ID NO: 3221 - protein, 42 aa, Artificial Sequence
  chemically synthesized
SQVSPFKIAIEELEDRVFVNCNTSIYRASTLSNCRHTSSVEE

SEQ ID NO: 3222 - protein, 42 aa, Artificial Sequence
  chemically synthesized
SQVSPFKIGIEELEDRVFVNCNTSIYRASTLSNCRHTSSVEE

SEQ ID NO: 3223 - protein, 42 aa, Artificial Sequence; identical to SEQ ID NO: 87
  chemically synthesized

SEQ ID NO: 3224 - protein, 42 aa, Artificial Sequence; identical to SEQ ID NO: 206
  chemically synthesized

SEQ ID NO: 3225 - protein, 42 aa, Artificial Sequence
  chemically synthesized
YQVSPFKIPIEELEDRVFVNCNTSIYRASSISNCRHTSSVEE

SEQ ID NO: 3226 - protein, 42 aa, Artificial Sequence; identical to SEQ ID NO: 326
  chemically synthesized

SEQ ID NO: 3227 - protein, 42 aa, Artificial Sequence; identical to SEQ ID NO: 444
  chemically synthesized

SEQ ID NO: 3228 - protein, 42 aa, Artificial Sequence
  chemically synthesized
SQISPFKIPIEELEDRVFVNCNTSIYRASSISNCRHTSSVEE

SEQ ID NO: 3229 - protein, 42 aa, Artificial Sequence
  chemically synthesized
SQPSPFKIPIEELEDRVFVNCNTSIYRASSISNCRHTSSVEE

SEQ ID NO: 3230 - protein, 42 aa, Artificial Sequence
  chemically synthesized
SQFSPFKIPIEELEDRVFVNCNTSIYRASSISNCRHTSSVEE

SEQ ID NO: 3231 - protein, 42 aa, Artificial Sequence; identical to SEQ ID NO: 563
  chemically synthesized

SEQ ID NO: 3232 - protein, 42 aa, Artificial Sequence
  chemically synthesized
SQVYPFKIPIEELEDRVFVNCNTSIYRASSISNCRHTSSVEE

SEQ ID NO: 3233 - protein, 42 aa, Artificial Sequence
  chemically synthesized
SQVSPWKIPIEELEDRVFVNCNTSIYRASSISNCRHTSSVEE

SEQ ID NO: 3234 - protein, 42 aa, Artificial Sequence
  chemically synthesized
SQVSPYKIPIEELEDRVFVNCNTSIYRASSISNCRHTSSVEE

SEQ ID NO: 3235 - protein, 42 aa, Artificial Sequence
  chemically synthesized
SQVSPHKIPIEELEDRVFVNCNTSIYRASSISNCRHTSSVEE

SEQ ID NO: 3236 - protein, 42 aa, Artificial Sequence
  chemically synthesized
SQVSPFRIPIEELEDRVFVNCNTSIYRASSISNCRHTSSVEE

SEQ ID NO: 3237 - protein, 42 aa, Artificial Sequence
  chemically synthesized
SQVSPFHIPIEELEDRVFVNCNTSIYRASSISNCRHTSSVEE

SEQ ID NO: 3238 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSISNCRHTSSVEE

SEQ ID NO: 3239 - protein, 42 aa, Artificial Sequence; identical to SEQ ID NO: 802
  chemically synthesized

SEQ ID NO: 3240 - protein, 42 aa, Artificial Sequence
  chemically synthesized
SQVSPFKHPIEELEDRVFVNCNTSIYRASSISNCRHTSSVEE

SEQ ID NO: 3241 - protein, 42 aa, Artificial Sequence
  chemically synthesized
SQVSPFKVPIEELEDRVFVNCNTSIYRASSISNCRHTSSVEE

SEQ ID NO: 3242 - protein, 42 aa, Artificial Sequence
  chemically synthesized
SQVSPFKFPIEELEDRVFVNCNTSIYRASSISNCRHTSSVEE

SEQ ID NO: 3243 - protein, 42 aa, Artificial Sequence
  chemically synthesized
SQVSPFKMPIEELEDRVFVNCNTSIYRASSISNCRHTSSVEE

SEQ ID NO: 3244 - protein, 42 aa, Artificial Sequence; identical to SEQ ID NO: 920
  chemically synthesized

SEQ ID NO: 3245 - protein, 42 aa, Artificial Sequence
  chemically synthesized
SQVSPFKIPHEELEDRVFVNCNTSIYRASSISNCRHTSSVEE

SEQ ID NO: 3246 - protein, 42 aa, Artificial Sequence
  chemically synthesized
SQVSPFKIPVEELEDRVFVNCNTSIYRASSISNCRHTSSVEE

SEQ ID NO: 3247 - protein, 42 aa, Artificial Sequence
  chemically synthesized
SQVSPFKIPFEELEDRVFVNCNTSIYRASSISNCRHTSSVEE

SEQ ID NO: 3248 - protein, 42 aa, Artificial Sequence
  chemically synthesized
SQVSPFKIPMEELEDRVFVNCNTSIYRASSISNCRHTSSVEE

SEQ ID NO: 3249 - protein, 42 aa, Artificial Sequence; identical to SEQ ID NO: 1040
  chemically synthesized

SEQ ID NO: 3250 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSISNCRHTSSVEE

SEQ ID NO: 3251 - protein, 42 aa, Artificial Sequence; identical to SEQ ID NO: 1160
  chemically synthesized

SEQ ID NO: 3252 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSISNCRHTSSVEE

SEQ ID NO: 3253 - protein, 42 aa, Artificial Sequence
  chemically synthesized
SQVSPFKIPIEEVEDRVFVNCNTSIYRASSISNCRHTSSVEE

SEQ ID NO: 3254 - protein, 42 aa, Artificial Sequence; identical to SEQ ID NO: 1277
  chemically synthesized

SEQ ID NO: 3255 - protein, 42 aa, Artificial Sequence
  chemically synthesized
SQVSPFKIPIEEFEDRVFVNCNTSIYRASSISNCRHTSSVEE

SEQ ID NO: 3256 - protein, 42 aa, Artificial Sequence
  chemically synthesized
SQVSPFKIPIEEHEDRVFVNCNTSIYRASSISNCRHTSSVEE

SEQ ID NO: 3257 - protein, 42 aa, Artificial Sequence
  chemically synthesized
SQVSPFKIPIEEMEDRVFVNCNTSIYRASSISNCRHTSSVEE

SEQ ID NO: 3258 - protein, 42 aa, Artificial Sequence; identical to SEQ ID NO: 1397
  chemically synthesized

SEQ ID NO: 3259 - protein, 42 aa, Artificial Sequence
  chemically synthesized
  misc_feature (14)..(14): Xaa can be a non-proteinogenic or synthetic amino acid like ornithin or selenocystein
SQVSPFKIPIEELXDRVFVNCNTSIYRASSISNCRHTSSVEE

SEQ ID NO: 3260 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSISNCRHTSSVEE

SEQ ID NO: 3261 - protein, 42 aa, Artificial Sequence
  chemically synthesized
SQVSPFKIPIEELEERVFVNCNTSIYRASSISNCRHTSSVEE

SEQ ID NO: 3262 - protein, 42 aa, Artificial Sequence; identical to SEQ ID NO: 1516
  chemically synthesized

SEQ ID NO: 3263 - protein, 42 aa, Artificial Sequence
  chemically synthesized
SQVSPFKIPIEELEDHVFVNCNTSIYRASSISNCRHTSSVEE

SEQ ID NO: 3264 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSISNCRHTSSVEE

SEQ ID NO: 3265 - protein, 42 aa, Artificial Sequence; identical to SEQ ID NO: 1633
  chemically synthesized

SEQ ID NO: 3266 - protein, 42 aa, Artificial Sequence
  chemically synthesized
SQVSPFKIPIEELEDRLFVNCNTSIYRASSISNCRHTSSVEE

SEQ ID NO: 3267 - protein, 42 aa, Artificial Sequence
  chemically synthesized
SQVSPFKIPIEELEDRFFVNCNTSIYRASSISNCRHTSSVEE

SEQ ID NO: 3268 - protein, 42 aa, Artificial Sequence
  chemically synthesized
SQVSPFKIPIEELEDRHFVNCNTSIYRASSISNCRHTSSVEE

SEQ ID NO: 3269 - protein, 42 aa, Artificial Sequence
  chemically synthesized
SQVSPFKIPIEELEDRMFVNCNTSIYRASSISNCRHTSSVEE

SEQ ID NO: 3270 - protein, 42 aa, Artificial Sequence; identical to SEQ ID NO: 1750
  chemically synthesized

SEQ ID NO: 3271 - protein, 42 aa, Artificial Sequence
  chemically synthesized
SQVSPFKIPIEELEDRVLVNCNTSIYRASSISNCRHTSSVEE

SEQ ID NO: 3272 - protein, 42 aa, Artificial Sequence
  chemically synthesized
SQVSPFKIPIEELEDRVVVNCNTSIYRASSISNCRHTSSVEE

SEQ ID NO: 3273 - protein, 42 aa, Artificial Sequence
  chemically synthesized
SQVSPFKIPIEELEDRVHVNCNTSIYRASSISNCRHTSSVEE

SEQ ID NO: 3274 - protein, 42 aa, Artificial Sequence
  chemically synthesized
SQVSPFKIPIEELEDRVMVNCNTSIYRASSISNCRHTSSVEE

SEQ ID NO: 3275 - protein, 42 aa, Artificial Sequence; identical to SEQ ID NO: 1867
  chemically synthesized

SEQ ID NO: 3276 - protein, 42 aa, Artificial Sequence
  chemically synthesized
SQVSPFKIPIEELEDRVFLNCNTSIYRASSISNCRHTSSVEE

SEQ ID NO: 3277 - protein, 42 aa, Artificial Sequence
  chemically synthesized
SQVSPFKIPIEELEDRVFFNCNTSIYRASSISNCRHTSSVEE

SEQ ID NO: 3278 - protein, 42 aa, Artificial Sequence
  chemically synthesized
SQVSPFKIPIEELEDRVFHNCNTSIYRASSISNCRHTSSVEE

SEQ ID NO: 3279 - protein, 42 aa, Artificial Sequence
  chemically synthesized
SQVSPFKIPIEELEDRVFMNCNTSIYRASSISNCRHTSSVEE

SEQ ID NO: 3280 - protein, 42 aa, Artificial Sequence; identical to SEQ ID NO: 1988
  chemically synthesized

SEQ ID NO: 3281 - protein, 42 aa, Artificial Sequence
  chemically synthesized
SQVSPFKIPIEELEDRVFVNSNTSIYRASSISNCRHTSSVEE

SEQ ID NO: 3282 - protein, 42 aa, Artificial Sequence
  chemically synthesized
SQVSPFKIPIEELEDRVFVNGNTSIYRASSISNCRHTSSVEE

SEQ ID NO: 3283 - protein, 42 aa, Artificial Sequence
  chemically synthesized
SQVSPFKIPIEELEDRVFVNANTSIYRASSISNCRHTSSVEE

SEQ ID NO: 3284 - protein, 42 aa, Artificial Sequence; identical to SEQ ID NO: 2229
  chemically synthesized

SEQ ID NO: 3285 - protein, 42 aa, Artificial Sequence; identical to SEQ ID NO: 2349
  chemically synthesized

SEQ ID NO: 3286 - protein, 42 aa, Artificial Sequence
  chemically synthesized
SQVSPFKIPIEELEDRVFVNCNYSIYRASSISNCRHTSSVEE

SEQ ID NO: 3287 - protein, 42 aa, Artificial Sequence; identical to SEQ ID NO: 2469
  chemically synthesized

SEQ ID NO: 3288 - protein, 42 aa, Artificial Sequence
  chemically synthesized
SQVSPFKIPIEELEDRVFVNCNTYIYRASSISNCRHTSSVEE

SEQ ID NO: 3289 - protein, 42 aa, Artificial Sequence
  chemically synthesized
SQVSPFKIPIEELEDRVFVNCNTSVYRASSISNCRHTSSVEE

SEQ ID NO: 3290 - protein, 42 aa, Artificial Sequence; identical to SEQ ID NO: 2586
  chemically synthesized

SEQ ID NO: 3291 - protein, 42 aa, Artificial Sequence
  chemically synthesized
SQVSPFKIPIEELEDRVFVNCNTSHYRASSISNCRHTSSVEE

SEQ ID NO: 3292 - protein, 42 aa, Artificial Sequence
  chemically synthesized
SQVSPFKIPIEELEDRVFVNCNTSFYRASSISNCRHTSSVEE

SEQ ID NO: 3293 - protein, 42 aa, Artificial Sequence
  chemically synthesized
SQVSPFKIPIEELEDRVFVNCNTSMYRASSISNCRHTSSVEE

SEQ ID NO: 3294 - protein, 42 aa, Artificial Sequence
  chemically synthesized
SQVSPFKIPIEELEDRVFVNCNTSIWRASSISNCRHTSSVEE

SEQ ID NO: 3295 - protein, 42 aa, Artificial Sequence
  chemically synthesized
SQVSPFKIPIEELEDRVFVNCNTSIFRASSISNCRHTSSVEE

SEQ ID NO: 3296 - protein, 42 aa, Artificial Sequence
  chemically synthesized
SQVSPFKIPIEELEDRVFVNCNTSISRASSISNCRHTSSVEE

SEQ ID NO: 3297 - protein, 42 aa, Artificial Sequence; identical to SEQ ID NO: 2704
  chemically synthesized

SEQ ID NO: 3298 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSISNCRHTSSVEE

SEQ ID NO: 3299 - protein, 42 aa, Artificial Sequence
  chemically synthesized
SQVSPFKIPIEELEDRVFVNCNTSIYHASSISNCRHTSSVEE

SEQ ID NO: 3300 - protein, 42 aa, Artificial Sequence; identical to SEQ ID NO: 2823
  chemically synthesized

SEQ ID NO: 3301 - protein, 42 aa, Artificial Sequence; identical to SEQ ID NO: 2944
  chemically synthesized

SEQ ID NO: 3302 - protein, 42 aa, Artificial Sequence; identical to SEQ ID NO: 3064
  chemically synthesized

SEQ ID NO: 3303 - protein, 42 aa, Artificial Sequence
  chemically synthesized
SQVSPFKIPIEELEDRVFVNCNTSIYRAYSISNCRHTSSVEE

SEQ ID NO: 3304 - protein, 42 aa, Artificial Sequence; identical to SEQ ID NO: 3184
  chemically synthesized

SEQ ID NO: 3305 - protein, 42 aa, Artificial Sequence
  chemically synthesized
SQVSPFKIPIEELEDRVFVNCNTSIYRASYISNCRHTSSVEE

SEQ ID NO: 3306 - protein, 42 aa, Artificial Sequence
  chemically synthesized
SQVSPFKIPIEELEDRVFVNCNTSIYRASSITNCRHTSSVEE

SEQ ID NO: 3307 - protein, 42 aa, Artificial Sequence
  chemically synthesized
SQVSPFKIPIEELEDRVFVNCNTSIYRASSIYNCRHTSSVEE

SEQ ID NO: 3308 - protein, 42 aa, Artificial Sequence
  chemically synthesized
SQVSPFKIPIEELEDRVFVNCNTSIYRASSISQCRHTSSVEE

SEQ ID NO: 3309 - protein, 42 aa, Artificial Sequence
  chemically synthesized
SQVSPFKIPIEELEDRVFVNCNTSIYRASSISNSRHTSSVEE

SEQ ID NO: 3310 - protein, 42 aa, Artificial Sequence
  chemically synthesized
SQVSPFKIPIEELEDRVFVNCNTSIYRASSISNGRHTSSVEE

SEQ ID NO: 3311 - protein, 42 aa, Artificial Sequence
  chemically synthesized
SQVSPFKIPIEELEDRVFVNCNTSIYRASSISNARHTSSVEE

SEQ ID NO: 3312 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRASSISNCXHTSSVEE

SEQ ID NO: 3313 - protein, 42 aa, Artificial Sequence
  chemically synthesized
SQVSPFKIPIEELEDRVFVNCNTSIYRASSISNCHHTSSVEE

SEQ ID NO: 3314 - protein, 42 aa, Artificial Sequence
  chemically synthesized
SQVSPFKIPIEELEDRVFVNCNTSIYRASSISNCKHTSSVEE

SEQ ID NO: 3315 - protein, 42 aa, Artificial Sequence
  chemically synthesized
SQVSPFKIPIEELEDRVFVNCNTSIYRASSISNCRGTSSVEE

SEQ ID NO: 3316 - protein, 42 aa, Artificial Sequence
  chemically synthesized
SQVSPFKIPIEELEDRVFVNCNTSIYRASSISNCRATSSVEE

SEQ ID NO: 3317 - protein, 42 aa, Artificial Sequence
  chemically synthesized
SQVSPFKIPIEELEDRVFVNCNTSIYRASSISNCRITSSVEE

SEQ ID NO: 3318 - protein, 42 aa, Artificial Sequence; identical to SEQ ID NO: 3317
  chemically synthesized

SEQ ID NO: 3319 - protein, 42 aa, Artificial Sequence
  chemically synthesized
SQVSPFKIPIEELEDRVFVNCNTSIYRASSISNCRMTSSVEE

SEQ ID NO: 3320 - protein, 42 aa, Artificial Sequence
  chemically synthesized
SQVSPFKIPIEELEDRVFVNCNTSIYRASSISNCRVTSSVEE

SEQ ID NO: 3321 - protein, 42 aa, Artificial Sequence
  chemically synthesized
SQVSPFKIPIEELEDRVFVNCNTSIYRASSISNCRHSSSVEE

SEQ ID NO: 3322 - protein, 42 aa, Artificial Sequence
  chemically synthesized
SQVSPFKIPIEELEDRVFVNCNTSIYRASSISNCRHYSSVEE

SEQ ID NO: 3323 - protein, 42 aa, Artificial Sequence
  chemically synthesized
SQVSPFKIPIEELEDRVFVNCNTSIYRASSISNCRHTTSVEE

SEQ ID NO: 3324 - protein, 42 aa, Artificial Sequence
  chemically synthesized
SQVSPFKIPIEELEDRVFVNCNTSIYRASSISNCRHTYSVEE

SEQ ID NO: 3325 - protein, 42 aa, Artificial Sequence
  chemically synthesized
SQVSPFKIPIEELEDRVFVNCNTSIYRASSISNCRHTSTVEE

SEQ ID NO: 3326 - protein, 42 aa, Artificial Sequence
  chemically synthesized
SQVSPFKIPIEELEDRVFVNCNTSIYRASSISNCRHTSYVEE

SEQ ID NO: 3327 - protein, 42 aa, Artificial Sequence
  chemically synthesized
SQVSPFKIPIEELEDRVFVNCNTSIYRASSISNCRHTSSIEE

SEQ ID NO: 3328 - protein, 42 aa, Artificial Sequence
  chemically synthesized
SQVSPFKIPIEELEDRVFVNCNTSIYRASSISNCRHTSSLEE

SEQ ID NO: 3329 - protein, 42 aa, Artificial Sequence
  chemically synthesized
SQVSPFKIPIEELEDRVFVNCNTSIYRASSISNCRHTSSFEE

SEQ ID NO: 3330 - protein, 42 aa, Artificial Sequence
  chemically synthesized
SQVSPFKIPIEELEDRVFVNCNTSIYRASSISNCRHTSSHEE

SEQ ID NO: 3331 - protein, 42 aa, Artificial Sequence
  chemically synthesized
SQVSPFKIPIEELEDRVFVNCNTSIYRASSISNCRHTSSMEE

SEQ ID NO: 3332 - protein, 42 aa, Artificial Sequence
  chemically synthesized
SQVSPFKIPIEELEDRVFVNCNTSIYRASSISNCRHTSSVDE

SEQ ID NO: 3333 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASSISNCRHTSSVXE

SEQ ID NO: 3334 - protein, 42 aa, Artificial Sequence
  chemically synthesized
SQVSPFKIPIEELEDRVFVNCNTSIYRASSISNCRHTSSVED

SEQ ID NO: 3335 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASSISNCRHTSSVEX

SEQ ID NO: 3336 - protein, 42 aa, Artificial Sequence
  chemically synthesized
SQVSAFKIPIEELEDRVFVNCNTSIYRASSISNCRHTSSVEE

SEQ ID NO: 3337 - protein, 42 aa, Artificial Sequence
  chemically synthesized
SQVSGFKIPIEELEDRVFVNCNTSIYRASSISNCRHTSSVEE

SEQ ID NO: 3338 - protein, 42 aa, Artificial Sequence
  chemically synthesized
SQVSPFKIAIEELEDRVFVNCNTSIYRASSISNCRHTSSVEE

SEQ ID NO: 3339 - protein, 42 aa, Artificial Sequence
  chemically synthesized
SQVSPFKIGIEELEDRVFVNCNTSIYRASSISNCRHTSSVEE

SEQ ID NO: 3340 - protein, 42 aa, Artificial Sequence; identical to SEQ ID NO: 92
  chemically synthesized

SEQ ID NO: 3341 - protein, 42 aa, Artificial Sequence; identical to SEQ ID NO: 211
  chemically synthesized

SEQ ID NO: 3342 - protein, 42 aa, Artificial Sequence
  chemically synthesized
YQVSPFKIPIEELEDRVFVNCNTSIYRASSLTNCRHTSSVEE

SEQ ID NO: 3343 - protein, 42 aa, Artificial Sequence; identical to SEQ ID NO: 331
  chemically synthesized

SEQ ID NO: 3344 - protein, 42 aa, Artificial Sequence; identical to SEQ ID NO: 449
  chemically synthesized

SEQ ID NO: 3345 - protein, 42 aa, Artificial Sequence
  chemically synthesized
SQISPFKIPIEELEDRVFVNCNTSIYRASSLTNCRHTSSVEE

SEQ ID NO: 3346 - protein, 42 aa, Artificial Sequence
  chemically synthesized
SQPSPFKIPIEELEDRVFVNCNTSIYRASSLTNCRHTSSVEE

SEQ ID NO: 3347 - protein, 42 aa, Artificial Sequence
  chemically synthesized
SQFSPFKIPIEELEDRVFVNCNTSIYRASSLTNCRHTSSVEE

SEQ ID NO: 3348 - protein, 42 aa, Artificial Sequence; identical to SEQ ID NO: 568
  chemically synthesized

SEQ ID NO: 3349 - protein, 42 aa, Artificial Sequence
  chemically synthesized
SQVYPFKIPIEELEDRVFVNCNTSIYRASSLTNCRHTSSVEE

SEQ ID NO: 3350 - protein, 42 aa, Artificial Sequence
  chemically synthesized
SQVSPWKIPIEELEDRVFVNCNTSIYRASSLTNCRHTSSVEE

SEQ ID NO: 3351 - protein, 42 aa, Artificial Sequence
  chemically synthesized
SQVSPYKIPIEELEDRVFVNCNTSIYRASSLTNCRHTSSVEE

SEQ ID NO: 3352 - protein, 42 aa, Artificial Sequence
  chemically synthesized
SQVSPHKIPIEELEDRVFVNCNTSIYRASSLTNCRHTSSVEE

SEQ ID NO: 3353 - protein, 42 aa, Artificial Sequence
  chemically synthesized
SQVSPFRIPIEELEDRVFVNCNTSIYRASSLTNCRHTSSVEE

SEQ ID NO: 3354 - protein, 42 aa, Artificial Sequence
  chemically synthesized
SQVSPFHIPIEELEDRVFVNCNTSIYRASSLTNCRHTSSVEE

SEQ ID NO: 3355 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSLTNCRHTSSVEE

SEQ ID NO: 3356 - protein, 42 aa, Artificial Sequence; identical to SEQ ID NO: 807
  chemically synthesized

SEQ ID NO: 3357 - protein, 42 aa, Artificial Sequence
  chemically synthesized
SQVSPFKHPIEELEDRVFVNCNTSIYRASSLTNCRHTSSVEE

SEQ ID NO: 3358 - protein, 42 aa, Artificial Sequence
  chemically synthesized
SQVSPFKVPIEELEDRVFVNCNTSIYRASSLTNCRHTSSVEE

SEQ ID NO: 3359 - protein, 42 aa, Artificial Sequence
  chemically synthesized
SQVSPFKFPIEELEDRVFVNCNTSIYRASSLTNCRHTSSVEE

SEQ ID NO: 3360 - protein, 42 aa, Artificial Sequence
  chemically synthesized
SQVSPFKMPIEELEDRVFVNCNTSIYRASSLTNCRHTSSVEE

SEQ ID NO: 3361 - protein, 42 aa, Artificial Sequence; identical to SEQ ID NO: 925
  chemically synthesized

SEQ ID NO: 3362 - protein, 42 aa, Artificial Sequence
  chemically synthesized
SQVSPFKIPHEELEDRVFVNCNTSIYRASSLTNCRHTSSVEE

SEQ ID NO: 3363 - protein, 42 aa, Artificial Sequence
  chemically synthesized
SQVSPFKIPVEELEDRVFVNCNTSIYRASSLTNCRHTSSVEE

SEQ ID NO: 3364 - protein, 42 aa, Artificial Sequence
  chemically synthesized
SQVSPFKIPFEELEDRVFVNCNTSIYRASSLTNCRHTSSVEE

SEQ ID NO: 3365 - protein, 42 aa, Artificial Sequence
  chemically synthesized
SQVSPFKIPMEELEDRVFVNCNTSIYRASSLTNCRHTSSVEE

SEQ ID NO: 3366 - protein, 42 aa, Artificial Sequence; identical to SEQ ID NO: 1045
  chemically synthesized

SEQ ID NO: 3367 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSLTNCRHTSSVEE

SEQ ID NO: 3368 - protein, 42 aa, Artificial Sequence; identical to SEQ ID NO: 1165
  chemically synthesized

SEQ ID NO: 3369 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSLTNCRHTSSVEE

SEQ ID NO: 3370 - protein, 42 aa, Artificial Sequence
  chemically synthesized
SQVSPFKIPIEEVEDRVFVNCNTSIYRASSLTNCRHTSSVEE

SEQ ID NO: 3371 - protein, 42 aa, Artificial Sequence; identical to SEQ ID NO: 1282
  chemically synthesized

SEQ ID NO: 3372 - protein, 42 aa, Artificial Sequence
  chemically synthesized
SQVSPFKIPIEEFEDRVFVNCNTSIYRASSLTNCRHTSSVEE

SEQ ID NO: 3373 - protein, 42 aa, Artificial Sequence
  chemically synthesized
SQVSPFKIPIEEHEDRVFVNCNTSIYRASSLTNCRHTSSVEE

SEQ ID NO: 3374 - protein, 42 aa, Artificial Sequence
  chemically synthesized
SQVSPFKIPIEEMEDRVFVNCNTSIYRASSLTNCRHTSSVEE

SEQ ID NO: 3375 - protein, 42 aa, Artificial Sequence; identical to SEQ ID NO: 1402
  chemically synthesized

SEQ ID NO: 3376 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASSLTNCRHTSSVEE

SEQ ID NO: 3377 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSLTNCRHTSSVEE

SEQ ID NO: 3378 - protein, 42 aa, Artificial Sequence
  chemically synthesized
SQVSPFKIPIEELEERVFVNCNTSIYRASSLTNCRHTSSVEE

SEQ ID NO: 3379 - protein, 42 aa, Artificial Sequence; identical to SEQ ID NO: 1521
  chemically synthesized

SEQ ID NO: 3380 - protein, 42 aa, Artificial Sequence
  chemically synthesized
SQVSPFKIPIEELEDHVFVNCNTSIYRASSLTNCRHTSSVEE

SEQ ID NO: 3381 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSLTNCRHTSSVEE

SEQ ID NO: 3382 - protein, 42 aa, Artificial Sequence; identical to SEQ ID NO: 1638
  chemically synthesized

SEQ ID NO: 3383 - protein, 42 aa, Artificial Sequence
  chemically synthesized
SQVSPFKIPIEELEDRLFVNCNTSIYRASSLTNCRHTSSVEE

SEQ ID NO: 3384 - protein, 42 aa, Artificial Sequence
  chemically synthesized
SQVSPFKIPIEELEDRFFVNCNTSIYRASSLTNCRHTSSVEE

SEQ ID NO: 3385 - protein, 42 aa, Artificial Sequence
  chemically synthesized
SQVSPFKIPIEELEDRHFVNCNTSIYRASSLTNCRHTSSVEE

SEQ ID NO: 3386 - protein, 42 aa, Artificial Sequence
  chemically synthesized
SQVSPFKIPIEELEDRMFVNCNTSIYRASSLTNCRHTSSVEE

SEQ ID NO: 3387 - protein, 42 aa, Artificial Sequence; identical to SEQ ID NO: 1755
  chemically synthesized

SEQ ID NO: 3388 - protein, 42 aa, Artificial Sequence
  chemically synthesized
SQVSPFKIPIEELEDRVLVNCNTSIYRASSLTNCRHTSSVEE

SEQ ID NO: 3389 - protein, 42 aa, Artificial Sequence
  chemically synthesized
SQVSPFKIPIEELEDRVVVNCNTSIYRASSLTNCRHTSSVEE

SEQ ID NO: 3390 - protein, 42 aa, Artificial Sequence
  chemically synthesized
SQVSPFKIPIEELEDRVHVNCNTSIYRASSLTNCRHTSSVEE

SEQ ID NO: 3391 - protein, 42 aa, Artificial Sequence
  chemically synthesized
SQVSPFKIPIEELEDRVMVNCNTSIYRASSLTNCRHTSSVEE

SEQ ID NO: 3392 - protein, 42 aa, Artificial Sequence; identical to SEQ ID NO: 1872
  chemically synthesized

SEQ ID NO: 3393 - protein, 42 aa, Artificial Sequence
  chemically synthesized
SQVSPFKIPIEELEDRVFLNCNTSIYRASSLTNCRHTSSVEE

SEQ ID NO: 3394 - protein, 42 aa, Artificial Sequence
  chemically synthesized
SQVSPFKIPIEELEDRVFFNCNTSIYRASSLTNCRHTSSVEE

SEQ ID NO: 3395 - protein, 42 aa, Artificial Sequence
  chemically synthesized
SQVSPFKIPIEELEDRVFHNCNTSIYRASSLTNCRHTSSVEE

SEQ ID NO: 3396 - protein, 42 aa, Artificial Sequence
  chemically synthesized
SQVSPFKIPIEELEDRVFMNCNTSIYRASSLTNCRHTSSVEE

SEQ ID NO: 3397 - protein, 42 aa, Artificial Sequence; identical to SEQ ID NO: 1993
  chemically synthesized

SEQ ID NO: 3398 - protein, 42 aa, Artificial Sequence
  chemically synthesized
SQVSPFKIPIEELEDRVFVNSNTSIYRASSLTNCRHTSSVEE

SEQ ID NO: 3399 - protein, 42 aa, Artificial Sequence
  chemically synthesized
SQVSPFKIPIEELEDRVFVNGNTSIYRASSLTNCRHTSSVEE

SEQ ID NO: 3400 - protein, 42 aa, Artificial Sequence
  chemically synthesized
SQVSPFKIPIEELEDRVFVNANTSIYRASSLTNCRHTSSVEE

SEQ ID NO: 3401 - protein, 42 aa, Artificial Sequence; identical to SEQ ID NO: 2234
  chemically synthesized

SEQ ID NO: 3402 - protein, 42 aa, Artificial Sequence; identical to SEQ ID NO: 2354
  chemically synthesized

SEQ ID NO: 3403 - protein, 42 aa, Artificial Sequence
  chemically synthesized
SQVSPFKIPIEELEDRVFVNCNYSIYRASSLTNCRHTSSVEE

SEQ ID NO: 3404 - protein, 42 aa, Artificial Sequence; identical to SEQ ID NO: 2474
  chemically synthesized

SEQ ID NO: 3405 - protein, 42 aa, Artificial Sequence
  chemically synthesized
SQVSPFKIPIEELEDRVFVNCNTYIYRASSLTNCRHTSSVEE

SEQ ID NO: 3406 - protein, 42 aa, Artificial Sequence
  chemically synthesized
SQVSPFKIPIEELEDRVFVNCNTSVYRASSLTNCRHTSSVEE

SEQ ID NO: 3407 - protein, 42 aa, Artificial Sequence; identical to SEQ ID NO: 2591
  chemically synthesized

SEQ ID NO: 3408 - protein, 42 aa, Artificial Sequence
  chemically synthesized
SQVSPFKIPIEELEDRVFVNCNTSHYRASSLTNCRHTSSVEE

SEQ ID NO: 3409 - protein, 42 aa, Artificial Sequence
  chemically synthesized
SQVSPFKIPIEELEDRVFVNCNTSFYRASSLTNCRHTSSVEE

SEQ ID NO: 3410 - protein, 42 aa, Artificial Sequence
  chemically synthesized
SQVSPFKIPIEELEDRVFVNCNTSMYRASSLTNCRHTSSVEE

SEQ ID NO: 3411 - protein, 42 aa, Artificial Sequence
  chemically synthesized
SQVSPFKIPIEELEDRVFVNCNTSIWRASSLTNCRHTSSVEE

SEQ ID NO: 3412 - protein, 42 aa, Artificial Sequence
  chemically synthesized
SQVSPFKIPIEELEDRVFVNCNTSIFRASSLTNCRHTSSVEE

SEQ ID NO: 3413 - protein, 42 aa, Artificial Sequence
  chemically synthesized
SQVSPFKIPIEELEDRVFVNCNTSISRASSLTNCRHTSSVEE

SEQ ID NO: 3414 - protein, 42 aa, Artificial Sequence; identical to SEQ ID NO: 2709
  chemically synthesized

SEQ ID NO: 3415 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSLTNCRHTSSVEE

SEQ ID NO: 3416 - protein, 42 aa, Artificial Sequence
  chemically synthesized
SQVSPFKIPIEELEDRVFVNCNTSIYHASSLTNCRHTSSVEE

SEQ ID NO: 3417 - protein, 42 aa, Artificial Sequence; identical to SEQ ID NO: 2828
  chemically synthesized

SEQ ID NO: 3418 - protein, 42 aa, Artificial Sequence; identical to SEQ ID NO: 2949
  chemically synthesized

SEQ ID NO: 3419 - protein, 42 aa, Artificial Sequence; identical to SEQ ID NO: 3069
  chemically synthesized

SEQ ID NO: 3420 - protein, 42 aa, Artificial Sequence
  chemically synthesized
SQVSPFKIPIEELEDRVFVNCNTSIYRAYSLTNCRHTSSVEE

SEQ ID NO: 3421 - protein, 42 aa, Artificial Sequence; identical to SEQ ID NO: 3189
  chemically synthesized

SEQ ID NO: 3422 - protein, 42 aa, Artificial Sequence
  chemically synthesized
SQVSPFKIPIEELEDRVFVNCNTSIYRASYLTNCRHTSSVEE

SEQ ID NO: 3423 - protein, 42 aa, Artificial Sequence; identical to SEQ ID NO: 3306
  chemically synthesized

SEQ ID NO: 3424 - protein, 42 aa, Artificial Sequence
  chemically synthesized
SQVSPFKIPIEELEDRVFVNCNTSIYRASSVTNCRHTSSVEE

SEQ ID NO: 3425 - protein, 42 aa, Artificial Sequence
  chemically synthesized
SQVSPFKIPIEELEDRVFVNCNTSIYRASSFTNCRHTSSVEE

SEQ ID NO: 3426 - protein, 42 aa, Artificial Sequence
  chemically synthesized
SQVSPFKIPIEELEDRVFVNCNTSIYRASSMTNCRHTSSVEE

SEQ ID NO: 3427 - protein, 42 aa, Artificial Sequence
  chemically synthesized
SQVSPFKIPIEELEDRVFVNCNTSIYRASSHTNCRHTSSVEE

SEQ ID NO: 3428 - protein, 42 aa, Artificial Sequence
  chemically synthesized
SQVSPFKIPIEELEDRVFVNCNTSIYRASSLTQCRHTSSVEE

SEQ ID NO: 3429 - protein, 42 aa, Artificial Sequence
  chemically synthesized
SQVSPFKIPIEELEDRVFVNCNTSIYRASSLTNSRHTSSVEE

SEQ ID NO: 3430 - protein, 42 aa, Artificial Sequence
  chemically synthesized
SQVSPFKIPIEELEDRVFVNCNTSIYRASSLTNGRHTSSVEE

SEQ ID NO: 3431 - protein, 42 aa, Artificial Sequence
  chemically synthesized
SQVSPFKIPIEELEDRVFVNCNTSIYRASSLTNARHTSSVEE

SEQ ID NO: 3432 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRASSLTNCXHTSSVEE

SEQ ID NO: 3433 - protein, 42 aa, Artificial Sequence
  chemically synthesized
SQVSPFKIPIEELEDRVFVNCNTSIYRASSLTNCHHTSSVEE

SEQ ID NO: 3434 - protein, 42 aa, Artificial Sequence
  chemically synthesized
SQVSPFKIPIEELEDRVFVNCNTSIYRASSLTNCKHTSSVEE

SEQ ID NO: 3435 - protein, 42 aa, Artificial Sequence
  chemically synthesized
SQVSPFKIPIEELEDRVFVNCNTSIYRASSLTNCRGTSSVEE

SEQ ID NO: 3436 - protein, 42 aa, Artificial Sequence
  chemically synthesized
SQVSPFKIPIEELEDRVFVNCNTSIYRASSLTNCRATSSVEE

SEQ ID NO: 3437 - protein, 42 aa, Artificial Sequence
  chemically synthesized
SQVSPFKIPIEELEDRVFVNCNTSIYRASSLTNCRITSSVEE

SEQ ID NO: 3438 - protein, 42 aa, Artificial Sequence
  chemically synthesized
SQVSPFKIPIEELEDRVFVNCNTSIYRASSLTNCRLTSSVEE

SEQ ID NO: 3439 - protein, 42 aa, Artificial Sequence
  chemically synthesized
SQVSPFKIPIEELEDRVFVNCNTSIYRASSLTNCRMTSSVEE

SEQ ID NO: 3440 - protein, 42 aa, Artificial Sequence
  chemically synthesized
SQVSPFKIPIEELEDRVFVNCNTSIYRASSLTNCRVTSSVEE

SEQ ID NO: 3441 - protein, 42 aa, Artificial Sequence
  chemically synthesized
SQVSPFKIPIEELEDRVFVNCNTSIYRASSLTNCRHSSSVEE

SEQ ID NO: 3442 - protein, 42 aa, Artificial Sequence
  chemically synthesized
SQVSPFKIPIEELEDRVFVNCNTSIYRASSLTNCRHYSSVEE

SEQ ID NO: 3443 - protein, 42 aa, Artificial Sequence
  chemically synthesized
SQVSPFKIPIEELEDRVFVNCNTSIYRASSLTNCRHTTSVEE

SEQ ID NO: 3444 - protein, 42 aa, Artificial Sequence
  chemically synthesized
SQVSPFKIPIEELEDRVFVNCNTSIYRASSLTNCRHTYSVEE

SEQ ID NO: 3445 - protein, 42 aa, Artificial Sequence
  chemically synthesized
SQVSPFKIPIEELEDRVFVNCNTSIYRASSLTNCRHTSTVEE

SEQ ID NO: 3446 - protein, 42 aa, Artificial Sequence
  chemically synthesized
SQVSPFKIPIEELEDRVFVNCNTSIYRASSLTNCRHTSYVEE

SEQ ID NO: 3447 - protein, 42 aa, Artificial Sequence
  chemically synthesized
SQVSPFKIPIEELEDRVFVNCNTSIYRASSLTNCRHTSSIEE

SEQ ID NO: 3448 - protein, 42 aa, Artificial Sequence
  chemically synthesized
SQVSPFKIPIEELEDRVFVNCNTSIYRASSLTNCRHTSSLEE

SEQ ID NO: 3449 - protein, 42 aa, Artificial Sequence
  chemically synthesized
SQVSPFKIPIEELEDRVFVNCNTSIYRASSLTNCRHTSSFEE

SEQ ID NO: 3450 - protein, 42 aa, Artificial Sequence
  chemically synthesized
SQVSPFKIPIEELEDRVFVNCNTSIYRASSLTNCRHTSSHEE

SEQ ID NO: 3451 - protein, 42 aa, Artificial Sequence
  chemically synthesized
SQVSPFKIPIEELEDRVFVNCNTSIYRASSLTNCRHTSSMEE

SEQ ID NO: 3452 - protein, 42 aa, Artificial Sequence
  chemically synthesized
SQVSPFKIPIEELEDRVFVNCNTSIYRASSLTNCRHTSSVDE

SEQ ID NO: 3453 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASSLTNCRHTSSVXE

SEQ ID NO: 3454 - protein, 42 aa, Artificial Sequence
  chemically synthesized
SQVSPFKIPIEELEDRVFVNCNTSIYRASSLTNCRHTSSVED

SEQ ID NO: 3455 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASSLTNCRHTSSVEX

SEQ ID NO: 3456 - protein, 42 aa, Artificial Sequence
  chemically synthesized
SQVSAFKIPIEELEDRVFVNCNTSIYRASSLTNCRHTSSVEE

SEQ ID NO: 3457 - protein, 42 aa, Artificial Sequence
  chemically synthesized
SQVSGFKIPIEELEDRVFVNCNTSIYRASSLTNCRHTSSVEE

SEQ ID NO: 3458 - protein, 42 aa, Artificial Sequence
  chemically synthesized
SQVSPFKIAIEELEDRVFVNCNTSIYRASSLTNCRHTSSVEE

SEQ ID NO: 3459 - protein, 42 aa, Artificial Sequence
  chemically synthesized
SQVSPFKIGIEELEDRVFVNCNTSIYRASSLTNCRHTSSVEE

SEQ ID NO: 3460 - protein, 42 aa, Artificial Sequence; identical to SEQ ID NO: 94
  chemically synthesized

SEQ ID NO: 3461 - protein, 42 aa, Artificial Sequence; identical to SEQ ID NO: 213
  chemically synthesized

SEQ ID NO: 3462 - protein, 42 aa, Artificial Sequence
  chemically synthesized
YQVSPFKIPIEELEDRVFVNCNTSIYRASSLSQCRHTSSVEE

SEQ ID NO: 3463 - protein, 42 aa, Artificial Sequence; identical to SEQ ID NO: 333
  chemically synthesized

SEQ ID NO: 3464 - protein, 42 aa, Artificial Sequence; identical to SEQ ID NO: 451
  chemically synthesized

SEQ ID NO: 3465 - protein, 42 aa, Artificial Sequence
  chemically synthesized
SQISPFKIPIEELEDRVFVNCNTSIYRASSLSQCRHTSSVEE

SEQ ID NO: 3466 - protein, 42 aa, Artificial Sequence
  chemically synthesized
SQPSPFKIPIEELEDRVFVNCNTSIYRASSLSQCRHTSSVEE

SEQ ID NO: 3467 - protein, 42 aa, Artificial Sequence
  chemically synthesized
SQFSPFKIPIEELEDRVFVNCNTSIYRASSLSQCRHTSSVEE

SEQ ID NO: 3468 - protein, 42 aa, Artificial Sequence; identical to SEQ ID NO: 570
  chemically synthesized

SEQ ID NO: 3469 - protein, 42 aa, Artificial Sequence
  chemically synthesized
SQVYPFKIPIEELEDRVFVNCNTSIYRASSLSQCRHTSSVEE

SEQ ID NO: 3470 - protein, 42 aa, Artificial Sequence
  chemically synthesized
SQVSPWKIPIEELEDRVFVNCNTSIYRASSLSQCRHTSSVEE

SEQ ID NO: 3471 - protein, 42 aa, Artificial Sequence
  chemically synthesized
SQVSPYKIPIEELEDRVFVNCNTSIYRASSLSQCRHTSSVEE

SEQ ID NO: 3472 - protein, 42 aa, Artificial Sequence
  chemically synthesized
SQVSPHKIPIEELEDRVFVNCNTSIYRASSLSQCRHTSSVEE

SEQ ID NO: 3473 - protein, 42 aa, Artificial Sequence
  chemically synthesized
SQVSPFRIPIEELEDRVFVNCNTSIYRASSLSQCRHTSSVEE

SEQ ID NO: 3474 - protein, 42 aa, Artificial Sequence
  chemically synthesized
SQVSPFHIPIEELEDRVFVNCNTSIYRASSLSQCRHTSSVEE

SEQ ID NO: 3475 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSLSQCRHTSSVEE

SEQ ID NO: 3476 - protein, 42 aa, Artificial Sequence; identical to SEQ ID NO: 809
  chemically synthesized

SEQ ID NO: 3477 - protein, 42 aa, Artificial Sequence
  chemically synthesized
SQVSPFKHPIEELEDRVFVNCNTSIYRASSLSQCRHTSSVEE

SEQ ID NO: 3478 - protein, 42 aa, Artificial Sequence
  chemically synthesized
SQVSPFKVPIEELEDRVFVNCNTSIYRASSLSQCRHTSSVEE

SEQ ID NO: 3479 - protein, 42 aa, Artificial Sequence
  chemically synthesized
SQVSPFKFPIEELEDRVFVNCNTSIYRASSLSQCRHTSSVEE

SEQ ID NO: 3480 - protein, 42 aa, Artificial Sequence
  chemically synthesized
SQVSPFKMPIEELEDRVFVNCNTSIYRASSLSQCRHTSSVEE

SEQ ID NO: 3481 - protein, 42 aa, Artificial Sequence; identical to SEQ ID NO: 927
  chemically synthesized

SEQ ID NO: 3482 - protein, 42 aa, Artificial Sequence
  chemically synthesized
SQVSPFKIPHEELEDRVFVNCNTSIYRASSLSQCRHTSSVEE

SEQ ID NO: 3483 - protein, 42 aa, Artificial Sequence
  chemically synthesized
SQVSPFKIPVEELEDRVFVNCNTSIYRASSLSQCRHTSSVEE

SEQ ID NO: 3484 - protein, 42 aa, Artificial Sequence
  chemically synthesized
SQVSPFKIPFEELEDRVFVNCNTSIYRASSLSQCRHTSSVEE

SEQ ID NO: 3485 - protein, 42 aa, Artificial Sequence
  chemically synthesized
SQVSPFKIPMEELEDRVFVNCNTSIYRASSLSQCRHTSSVEE

SEQ ID NO: 3486 - protein, 42 aa, Artificial Sequence; identical to SEQ ID NO: 1047
  chemically synthesized

SEQ ID NO: 3487 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSLSQCRHTSSVEE

SEQ ID NO: 3488 - protein, 42 aa, Artificial Sequence; identical to SEQ ID NO: 1167
  chemically synthesized

SEQ ID NO: 3489 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSLSQCRHTSSVEE

SEQ ID NO: 3490 - protein, 42 aa, Artificial Sequence
  chemically synthesized
SQVSPFKIPIEEVEDRVFVNCNTSIYRASSLSQCRHTSSVEE

SEQ ID NO: 3491 - protein, 42 aa, Artificial Sequence; identical to SEQ ID NO: 1284
  chemically synthesized

SEQ ID NO: 3492 - protein, 42 aa, Artificial Sequence
  chemically synthesized
SQVSPFKIPIEEFEDRVFVNCNTSIYRASSLSQCRHTSSVEE

SEQ ID NO: 3493 - protein, 42 aa, Artificial Sequence
  chemically synthesized
SQVSPFKIPIEEHEDRVFVNCNTSIYRASSLSQCRHTSSVEE

SEQ ID NO: 3494 - protein, 42 aa, Artificial Sequence
  chemically synthesized
SQVSPFKIPIEEMEDRVFVNCNTSIYRASSLSQCRHTSSVEE

SEQ ID NO: 3495 - protein, 42 aa, Artificial Sequence; identical to SEQ ID NO: 1404
  chemically synthesized

SEQ ID NO: 3496 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASSLSQCRHTSSVEE

SEQ ID NO: 3497 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSLSQCRHTSSVEE

SEQ ID NO: 3498 - protein, 42 aa, Artificial Sequence
  chemically synthesized
SQVSPFKIPIEELEERVFVNCNTSIYRASSLSQCRHTSSVEE

SEQ ID NO: 3499 - protein, 42 aa, Artificial Sequence; identical to SEQ ID NO: 1523
  chemically synthesized

SEQ ID NO: 3500 - protein, 42 aa, Artificial Sequence
  chemically synthesized
SQVSPFKIPIEELEDHVFVNCNTSIYRASSLSQCRHTSSVEE

SEQ ID NO: 3501 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSLSQCRHTSSVEE

SEQ ID NO: 3502 - protein, 42 aa, Artificial Sequence; identical to SEQ ID NO: 1640
  chemically synthesized

SEQ ID NO: 3503 - protein, 42 aa, Artificial Sequence
  chemically synthesized
SQVSPFKIPIEELEDRLFVNCNTSIYRASSLSQCRHTSSVEE

SEQ ID NO: 3504 - protein, 42 aa, Artificial Sequence
  chemically synthesized
SQVSPFKIPIEELEDRFFVNCNTSIYRASSLSQCRHTSSVEE

SEQ ID NO: 3505 - protein, 42 aa, Artificial Sequence
  chemically synthesized
SQVSPFKIPIEELEDRHFVNCNTSIYRASSLSQCRHTSSVEE

SEQ ID NO: 3506 - protein, 42 aa, Artificial Sequence
  chemically synthesized
SQVSPFKIPIEELEDRMFVNCNTSIYRASSLSQCRHTSSVEE

SEQ ID NO: 3507 - protein, 42 aa, Artificial Sequence; identical to SEQ ID NO: 1757
  chemically synthesized

SEQ ID NO: 3508 - protein, 42 aa, Artificial Sequence
  chemically synthesized
SQVSPFKIPIEELEDRVLVNCNTSIYRASSLSQCRHTSSVEE

SEQ ID NO: 3509 - protein, 42 aa, Artificial Sequence
  chemically synthesized
SQVSPFKIPIEELEDRVVVNCNTSIYRASSLSQCRHTSSVEE

SEQ ID NO: 3510 - protein, 42 aa, Artificial Sequence
  chemically synthesized
SQVSPFKIPIEELEDRVHVNCNTSIYRASSLSQCRHTSSVEE

SEQ ID NO: 3511 - protein, 42 aa, Artificial Sequence
  chemically synthesized
SQVSPFKIPIEELEDRVMVNCNTSIYRASSLSQCRHTSSVEE

SEQ ID NO: 3512 - protein, 42 aa, Artificial Sequence; identical to SEQ ID NO: 1874
  chemically synthesized

SEQ ID NO: 3513 - protein, 42 aa, Artificial Sequence
  chemically synthesized
SQVSPFKIPIEELEDRVFLNCNTSIYRASSLSQCRHTSSVEE

SEQ ID NO: 3514 - protein, 42 aa, Artificial Sequence
  chemically synthesized
SQVSPFKIPIEELEDRVFFNCNTSIYRASSLSQCRHTSSVEE

SEQ ID NO: 3515 - protein, 42 aa, Artificial Sequence
  chemically synthesized
SQVSPFKIPIEELEDRVFHNCNTSIYRASSLSQCRHTSSVEE

SEQ ID NO: 3516 - protein, 42 aa, Artificial Sequence
  chemically synthesized
SQVSPFKIPIEELEDRVFMNCNTSIYRASSLSQCRHTSSVEE

SEQ ID NO: 3517 - protein, 42 aa, Artificial Sequence; identical to SEQ ID NO: 1995
  chemically synthesized

SEQ ID NO: 3518 - protein, 42 aa, Artificial Sequence
  chemically synthesized
SQVSPFKIPIEELEDRVFVNSNTSIYRASSLSQCRHTSSVEE

SEQ ID NO: 3519 - protein, 42 aa, Artificial Sequence
  chemically synthesized
SQVSPFKIPIEELEDRVFVNGNTSIYRASSLSQCRHTSSVEE

SEQ ID NO: 3520 - protein, 42 aa, Artificial Sequence
  chemically synthesized
SQVSPFKIPIEELEDRVFVNANTSIYRASSLSQCRHTSSVEE

SEQ ID NO: 3521 - protein, 42 aa, Artificial Sequence; identical to SEQ ID NO: 2236
  chemically synthesized

SEQ ID NO: 3522 - protein, 42 aa, Artificial Sequence; identical to SEQ ID NO: 2356
  chemically synthesized

SEQ ID NO: 3523 - protein, 42 aa, Artificial Sequence
  chemically synthesized
SQVSPFKIPIEELEDRVFVNCNYSIYRASSLSQCRHTSSVEE

SEQ ID NO: 3524 - protein, 42 aa, Artificial Sequence; identical to SEQ ID NO: 2476
  chemically synthesized

SEQ ID NO: 3525 - protein, 42 aa, Artificial Sequence
  chemically synthesized
SQVSPFKIPIEELEDRVFVNCNTYIYRASSLSQCRHTSSVEE

SEQ ID NO: 3526 - protein, 42 aa, Artificial Sequence
  chemically synthesized
SQVSPFKIPIEELEDRVFVNCNTSVYRASSLSQCRHTSSVEE

SEQ ID NO: 3527 - protein, 42 aa, Artificial Sequence; identical to SEQ ID NO: 2593
  chemically synthesized

SEQ ID NO: 3528 - protein, 42 aa, Artificial Sequence
  chemically synthesized
SQVSPFKIPIEELEDRVFVNCNTSHYRASSLSQCRHTSSVEE

SEQ ID NO: 3529 - protein, 42 aa, Artificial Sequence
  chemically synthesized
SQVSPFKIPIEELEDRVFVNCNTSFYRASSLSQCRHTSSVEE

SEQ ID NO: 3530 - protein, 42 aa, Artificial Sequence
  chemically synthesized
SQVSPFKIPIEELEDRVFVNCNTSMYRASSLSQCRHTSSVEE

SEQ ID NO: 3531 - protein, 42 aa, Artificial Sequence
  chemically synthesized
SQVSPFKIPIEELEDRVFVNCNTSIWRASSLSQCRHTSSVEE

SEQ ID NO: 3532 - protein, 42 aa, Artificial Sequence
  chemically synthesized
SQVSPFKIPIEELEDRVFVNCNTSIFRASSLSQCRHTSSVEE

SEQ ID NO: 3533 - protein, 42 aa, Artificial Sequence
  chemically synthesized
SQVSPFKIPIEELEDRVFVNCNTSISRASSLSQCRHTSSVEE

SEQ ID NO: 3534 - protein, 42 aa, Artificial Sequence; identical to SEQ ID NO: 2711
  chemically synthesized

SEQ ID NO: 3535 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSLSQCRHTSSVEE

SEQ ID NO: 3536 - protein, 42 aa, Artificial Sequence
  chemically synthesized
SQVSPFKIPIEELEDRVFVNCNTSIYHASSLSQCRHTSSVEE

SEQ ID NO: 3537 - protein, 42 aa, Artificial Sequence; identical to SEQ ID NO: 2830
  chemically synthesized

SEQ ID NO: 3538 - protein, 42 aa, Artificial Sequence; identical to SEQ ID NO: 2951
  chemically synthesized

SEQ ID NO: 3539 - protein, 42 aa, Artificial Sequence; identical to SEQ ID NO: 3071
  chemically synthesized

SEQ ID NO: 3540 - protein, 42 aa, Artificial Sequence
  chemically synthesized
SQVSPFKIPIEELEDRVFVNCNTSIYRAYSLSQCRHTSSVEE

SEQ ID NO: 3541 - protein, 42 aa, Artificial Sequence; identical to SEQ ID NO: 3191
  chemically synthesized

SEQ ID NO: 3542 - protein, 42 aa, Artificial Sequence
  chemically synthesized
SQVSPFKIPIEELEDRVFVNCNTSIYRASYLSQCRHTSSVEE

SEQ ID NO: 3543 - protein, 42 aa, Artificial Sequence; identical to SEQ ID NO: 3308
  chemically synthesized

SEQ ID NO: 3544 - protein, 42 aa, Artificial Sequence
  chemically synthesized
SQVSPFKIPIEELEDRVFVNCNTSIYRASSVSQCRHTSSVEE

SEQ ID NO: 3545 - protein, 42 aa, Artificial Sequence
  chemically synthesized
SQVSPFKIPIEELEDRVFVNCNTSIYRASSFSQCRHTSSVEE

SEQ ID NO: 3546 - protein, 42 aa, Artificial Sequence
  chemically synthesized
SQVSPFKIPIEELEDRVFVNCNTSIYRASSMSQCRHTSSVEE

SEQ ID NO: 3547 - protein, 42 aa, Artificial Sequence
  chemically synthesized
SQVSPFKIPIEELEDRVFVNCNTSIYRASSHSQCRHTSSVEE

SEQ ID NO: 3548 - protein, 42 aa, Artificial Sequence; identical to SEQ ID NO: 3428
  chemically synthesized

SEQ ID NO: 3549 - protein, 42 aa, Artificial Sequence
  chemically synthesized
SQVSPFKIPIEELEDRVFVNCNTSIYRASSLYQCRHTSSVEE

SEQ ID NO: 3550 - protein, 42 aa, Artificial Sequence
  chemically synthesized
SQVSPFKIPIEELEDRVFVNCNTSIYRASSLSQSRHTSSVEE

SEQ ID NO: 3551 - protein, 42 aa, Artificial Sequence
  chemically synthesized
SQVSPFKIPIEELEDRVFVNCNTSIYRASSLSQGRHTSSVEE

SEQ ID NO: 3552 - protein, 42 aa, Artificial Sequence
  chemically synthesized
SQVSPFKIPIEELEDRVFVNCNTSIYRASSLSQARHTSSVEE

SEQ ID NO: 3553 - protein, 42 aa, Artificial Sequence
  chemically synthesized
  misc_feature (35)..(35): Xaa can be a non-proteinogenic or synthetic amino acid like ornithin or selenocystein
SQVSPFKIPIEELEDRVFVNCNTSIYRASSLSQCXHTSSVEE

SEQ ID NO: 3554 - protein, 42 aa, Artificial Sequence
  chemically synthesized
SQVSPFKIPIEELEDRVFVNCNTSIYRASSLSQCHHTSSVEE

SEQ ID NO: 3555 - protein, 42 aa, Artificial Sequence
  chemically synthesized
SQVSPFKIPIEELEDRVFVNCNTSIYRASSLSQCKHTSSVEE

SEQ ID NO: 3556 - protein, 42 aa, Artificial Sequence
  chemically synthesized
SQVSPFKIPIEELEDRVFVNCNTSIYRASSLSQCRGTSSVEE

SEQ ID NO: 3557 - protein, 42 aa, Artificial Sequence
  chemically synthesized
SQVSPFKIPIEELEDRVFVNCNTSIYRASSLSQCRATSSVEE

SEQ ID NO: 3558 - protein, 42 aa, Artificial Sequence
  chemically synthesized
SQVSPFKIPIEELEDRVFVNCNTSIYRASSLSQCRITSSVEE

SEQ ID NO: 3559 - protein, 42 aa, Artificial Sequence
  chemically synthesized
SQVSPFKIPIEELEDRVFVNCNTSIYRASSLSQCRLTSSVEE

SEQ ID NO: 3560 - protein, 42 aa, Artificial Sequence
  chemically synthesized
SQVSPFKIPIEELEDRVFVNCNTSIYRASSLSQCRMTSSVEE

SEQ ID NO: 3561 - protein, 42 aa, Artificial Sequence
  chemically synthesized
SQVSPFKIPIEELEDRVFVNCNTSIYRASSLSQCRVTSSVEE

SEQ ID NO: 3562 - protein, 42 aa, Artificial Sequence
  chemically synthesized
SQVSPFKIPIEELEDRVFVNCNTSIYRASSLSQCRHSSSVEE

SEQ ID NO: 3563 - protein, 42 aa, Artificial Sequence
  chemically synthesized
SQVSPFKIPIEELEDRVFVNCNTSIYRASSLSQCRHYSSVEE

SEQ ID NO: 3564 - protein, 42 aa, Artificial Sequence
  chemically synthesized
SQVSPFKIPIEELEDRVFVNCNTSIYRASSLSQCRHTTSVEE

SEQ ID NO: 3565 - protein, 42 aa, Artificial Sequence
  chemically synthesized
SQVSPFKIPIEELEDRVFVNCNTSIYRASSLSQCRHTYSVEE

SEQ ID NO: 3566 - protein, 42 aa, Artificial Sequence
  chemically synthesized
SQVSPFKIPIEELEDRVFVNCNTSIYRASSLSQCRHTSTVEE

SEQ ID NO: 3567 - protein, 42 aa, Artificial Sequence
  chemically synthesized
SQVSPFKIPIEELEDRVFVNCNTSIYRASSLSQCRHTSYVEE

SEQ ID NO: 3568 - protein, 42 aa, Artificial Sequence
  chemically synthesized
SQVSPFKIPIEELEDRVFVNCNTSIYRASSLSQCRHTSSIEE

SEQ ID NO: 3569 - protein, 42 aa, Artificial Sequence
  chemically synthesized
SQVSPFKIPIEELEDRVFVNCNTSIYRASSLSQCRHTSSLEE

SEQ ID NO: 3570 - protein, 42 aa, Artificial Sequence
  chemically synthesized
SQVSPFKIPIEELEDRVFVNCNTSIYRASSLSQCRHTSSFEE

SEQ ID NO: 3571 - protein, 42 aa, Artificial Sequence
  chemically synthesized
SQVSPFKIPIEELEDRVFVNCNTSIYRASSLSQCRHTSSHEE

SEQ ID NO: 3572 - protein, 42 aa, Artificial Sequence
  chemically synthesized
SQVSPFKIPIEELEDRVFVNCNTSIYRASSLSQCRHTSSMEE

SEQ ID NO: 3573 - protein, 42 aa, Artificial Sequence
  chemically synthesized
SQVSPFKIPIEELEDRVFVNCNTSIYRASSLSQCRHTSSVDE

SEQ ID NO: 3574 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASSLSQCRHTSSVXE

SEQ ID NO: 3575 - protein, 42 aa, Artificial Sequence
  chemically synthesized
SQVSPFKIPIEELEDRVFVNCNTSIYRASSLSQCRHTSSVED

SEQ ID NO: 3576 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASSLSQCRHTSSVEX

SEQ ID NO: 3577 - protein, 42 aa, Artificial Sequence
  chemically synthesized
SQVSAFKIPIEELEDRVFVNCNTSIYRASSLSQCRHTSSVEE

SEQ ID NO: 3578 - protein, 42 aa, Artificial Sequence
  chemically synthesized
SQVSGFKIPIEELEDRVFVNCNTSIYRASSLSQCRHTSSVEE

SEQ ID NO: 3579 - protein, 42 aa, Artificial Sequence
  chemically synthesized
SQVSPFKIAIEELEDRVFVNCNTSIYRASSLSQCRHTSSVEE

SEQ ID NO: 3580 - protein, 42 aa, Artificial Sequence
  chemically synthesized
SQVSPFKIGIEELEDRVFVNCNTSIYRASSLSQCRHTSSVEE

SEQ ID NO: 3581 - protein, 42 aa, Artificial Sequence; identical to SEQ ID NO: 100
  chemically synthesized

SEQ ID NO: 3582 - protein, 42 aa, Artificial Sequence; identical to SEQ ID NO: 219
  chemically synthesized

SEQ ID NO: 3583 - protein, 42 aa, Artificial Sequence
  chemically synthesized
YQVSPFKIPIEELEDRVFVNCNTSIYRASSLSNCKHTSSVEE

SEQ ID NO: 3584 - protein, 42 aa, Artificial Sequence; identical to SEQ ID NO: 339
  chemically synthesized

SEQ ID NO: 3585 - protein, 42 aa, Artificial Sequence; identical to SEQ ID NO: 457
  chemically synthesized

SEQ ID NO: 3586 - protein, 42 aa, Artificial Sequence
  chemically synthesized
SQISPFKIPIEELEDRVFVNCNTSIYRASSLSNCKHTSSVEE

SEQ ID NO: 3587 - protein, 42 aa, Artificial Sequence
  chemically synthesized
SQPSPFKIPIEELEDRVFVNCNTSIYRASSLSNCKHTSSVEE

SEQ ID NO: 3588 - protein, 42 aa, Artificial Sequence
  chemically synthesized
SQFSPFKIPIEELEDRVFVNCNTSIYRASSLSNCKHTSSVEE

SEQ ID NO: 3589 - protein, 42 aa, Artificial Sequence; identical to SEQ ID NO: 576
  chemically synthesized

SEQ ID NO: 3590 - protein, 42 aa, Artificial Sequence
  chemically synthesized
SQVYPFKIPIEELEDRVFVNCNTSIYRASSLSNCKHTSSVEE

SEQ ID NO: 3591 - protein, 42 aa, Artificial Sequence
  chemically synthesized
SQVSPWKIPIEELEDRVFVNCNTSIYRASSLSNCKHTSSVEE

SEQ ID NO: 3592 - protein, 42 aa, Artificial Sequence
  chemically synthesized
SQVSPYKIPIEELEDRVFVNCNTSIYRASSLSNCKHTSSVEE

SEQ ID NO: 3593 - protein, 42 aa, Artificial Sequence
  chemically synthesized
SQVSPHKIPIEELEDRVFVNCNTSIYRASSLSNCKHTSSVEE

SEQ ID NO: 3594 - protein, 42 aa, Artificial Sequence
  chemically synthesized
SQVSPFRIPIEELEDRVFVNCNTSIYRASSLSNCKHTSSVEE

SEQ ID NO: 3595 - protein, 42 aa, Artificial Sequence
  chemically synthesized
SQVSPFHIPIEELEDRVFVNCNTSIYRASSLSNCKHTSSVEE

SEQ ID NO: 3596 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSLSNCKHTSSVEE

SEQ ID NO: 3597 - protein, 42 aa, Artificial Sequence; identical to SEQ ID NO: 815
  chemically synthesized

SEQ ID NO: 3598 - protein, 42 aa, Artificial Sequence
  chemically synthesized
SQVSPFKHPIEELEDRVFVNCNTSIYRASSLSNCKHTSSVEE

SEQ ID NO: 3599 - protein, 42 aa, Artificial Sequence
  chemically synthesized
SQVSPFKVPIEELEDRVFVNCNTSIYRASSLSNCKHTSSVEE

SEQ ID NO: 3600 - protein, 42 aa, Artificial Sequence
  chemically synthesized
SQVSPFKFPIEELEDRVFVNCNTSIYRASSLSNCKHTSSVEE

SEQ ID NO: 3601 - protein, 42 aa, Artificial Sequence
  chemically synthesized
SQVSPFKMPIEELEDRVFVNCNTSIYRASSLSNCKHTSSVEE

SEQ ID NO: 3602 - protein, 42 aa, Artificial Sequence; identical to SEQ ID NO: 933
  chemically synthesized

SEQ ID NO: 3603 - protein, 42 aa, Artificial Sequence
  chemically synthesized
SQVSPFKIPHEELEDRVFVNCNTSIYRASSLSNCKHTSSVEE

SEQ ID NO: 3604 - protein, 42 aa, Artificial Sequence
  chemically synthesized
SQVSPFKIPVEELEDRVFVNCNTSIYRASSLSNCKHTSSVEE

SEQ ID NO: 3605 - protein, 42 aa, Artificial Sequence
  chemically synthesized
SQVSPFKIPFEELEDRVFVNCNTSIYRASSLSNCKHTSSVEE

SEQ ID NO: 3606 - protein, 42 aa, Artificial Sequence
  chemically synthesized
SQVSPFKIPMEELEDRVFVNCNTSIYRASSLSNCKHTSSVEE

SEQ ID NO: 3607 - protein, 42 aa, Artificial Sequence; identical to SEQ ID NO: 1053
  chemically synthesized

SEQ ID NO: 3608 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSLSNCKHTSSVEE

SEQ ID NO: 3609 - protein, 42 aa, Artificial Sequence; identical to SEQ ID NO: 1173
  chemically synthesized

SEQ ID NO: 3610 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSLSNCKHTSSVEE

SEQ ID NO: 3611 - protein, 42 aa, Artificial Sequence
  chemically synthesized
SQVSPFKIPIEEVEDRVFVNCNTSIYRASSLSNCKHTSSVEE

SEQ ID NO: 3612 - protein, 42 aa, Artificial Sequence; identical to SEQ ID NO: 1290
  chemically synthesized

SEQ ID NO: 3613 - protein, 42 aa, Artificial Sequence
  chemically synthesized
SQVSPFKIPIEEFEDRVFVNCNTSIYRASSLSNCKHTSSVEE

SEQ ID NO: 3614 - protein, 42 aa, Artificial Sequence
  chemically synthesized
SQVSPFKIPIEEHEDRVFVNCNTSIYRASSLSNCKHTSSVEE

SEQ ID NO: 3615 - protein, 42 aa, Artificial Sequence
  chemically synthesized
SQVSPFKIPIEEMEDRVFVNCNTSIYRASSLSNCKHTSSVEE

SEQ ID NO: 3616 - protein, 42 aa, Artificial Sequence; identical to SEQ ID NO: 1410
  chemically synthesized

SEQ ID NO: 3617 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASSLSNCKHTSSVEE

SEQ ID NO: 3618 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSLSNCKHTSSVEE

SEQ ID NO: 3619 - protein, 42 aa, Artificial Sequence
  chemically synthesized
SQVSPFKIPIEELEERVFVNCNTSIYRASSLSNCKHTSSVEE

SEQ ID NO: 3620 - protein, 42 aa, Artificial Sequence; identical to SEQ ID NO: 1529
  chemically synthesized

SEQ ID NO: 3621 - protein, 42 aa, Artificial Sequence
  chemically synthesized
SQVSPFKIPIEELEDHVFVNCNTSIYRASSLSNCKHTSSVEE

SEQ ID NO: 3622 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSLSNCKHTSSVEE

SEQ ID NO: 3623 - protein, 42 aa, Artificial Sequence; identical to SEQ ID NO: 1646
  chemically synthesized

SEQ ID NO: 3624 - protein, 42 aa, Artificial Sequence
  chemically synthesized
SQVSPFKIPIEELEDRLFVNCNTSIYRASSLSNCKHTSSVEE

SEQ ID NO: 3625 - protein, 42 aa, Artificial Sequence
  chemically synthesized
SQVSPFKIPIEELEDRFFVNCNTSIYRASSLSNCKHTSSVEE

SEQ ID NO: 3626 - protein, 42 aa, Artificial Sequence
  chemically synthesized
SQVSPFKIPIEELEDRHFVNCNTSIYRASSLSNCKHTSSVEE

SEQ ID NO: 3627 - protein, 42 aa, Artificial Sequence
  chemically synthesized
SQVSPFKIPIEELEDRMFVNCNTSIYRASSLSNCKHTSSVEE

SEQ ID NO: 3628 - protein, 42 aa, Artificial Sequence; identical to SEQ ID NO: 1763
  chemically synthesized

SEQ ID NO: 3629 - protein, 42 aa, Artificial Sequence
  chemically synthesized
SQVSPFKIPIEELEDRVLVNCNTSIYRASSLSNCKHTSSVEE

SEQ ID NO: 3630 - protein, 42 aa, Artificial Sequence
  chemically synthesized
SQVSPFKIPIEELEDRVVVNCNTSIYRASSLSNCKHTSSVEE

SEQ ID NO: 3631 - protein, 42 aa, Artificial Sequence
  chemically synthesized
SQVSPFKIPIEELEDRVHVNCNTSIYRASSLSNCKHTSSVEE

SEQ ID NO: 3632 - protein, 42 aa, Artificial Sequence
  chemically synthesized
SQVSPFKIPIEELEDRVMVNCNTSIYRASSLSNCKHTSSVEE

SEQ ID NO: 3633 - protein, 42 aa, Artificial Sequence; identical to SEQ ID NO: 1880
  chemically synthesized

SEQ ID NO: 3634 - protein, 42 aa, Artificial Sequence
  chemically synthesized
SQVSPFKIPIEELEDRVFLNCNTSIYRASSLSNCKHTSSVEE

SEQ ID NO: 3635 - protein, 42 aa, Artificial Sequence
  chemically synthesized
SQVSPFKIPIEELEDRVFFNCNTSIYRASSLSNCKHTSSVEE

SEQ ID NO: 3636 - protein, 42 aa, Artificial Sequence
  chemically synthesized
SQVSPFKIPIEELEDRVFHNCNTSIYRASSLSNCKHTSSVEE

SEQ ID NO: 3637 - protein, 42 aa, Artificial Sequence
  chemically synthesized
SQVSPFKIPIEELEDRVFMNCNTSIYRASSLSNCKHTSSVEE

SEQ ID NO: 3638 - protein, 42 aa, Artificial Sequence; identical to SEQ ID NO: 2001
  chemically synthesized

SEQ ID NO: 3639 - protein, 42 aa, Artificial Sequence
  chemically synthesized
SQVSPFKIPIEELEDRVFVNSNTSIYRASSLSNCKHTSSVEE

SEQ ID NO: 3640 - protein, 42 aa, Artificial Sequence
  chemically synthesized
SQVSPFKIPIEELEDRVFVNGNTSIYRASSLSNCKHTSSVEE

SEQ ID NO: 3641 - protein, 42 aa, Artificial Sequence
  chemically synthesized
SQVSPFKIPIEELEDRVFVNANTSIYRASSLSNCKHTSSVEE

SEQ ID NO: 3642 - protein, 42 aa, Artificial Sequence; identical to SEQ ID NO: 2242
  chemically synthesized

SEQ ID NO: 3643 - protein, 42 aa, Artificial Sequence; identical to SEQ ID NO: 2362
  chemically synthesized

SEQ ID NO: 3644 - protein, 42 aa, Artificial Sequence
  chemically synthesized
SQVSPFKIPIEELEDRVFVNCNYSIYRASSLSNCKHTSSVEE

SEQ ID NO: 3645 - protein, 42 aa, Artificial Sequence; identical to SEQ ID NO: 2482
  chemically synthesized

SEQ ID NO: 3646 - protein, 42 aa, Artificial Sequence
  chemically synthesized
SQVSPFKIPIEELEDRVFVNCNTYIYRASSLSNCKHTSSVEE

SEQ ID NO: 3647 - protein, 42 aa, Artificial Sequence
  chemically synthesized
SQVSPFKIPIEELEDRVFVNCNTSVYRASSLSNCKHTSSVEE

SEQ ID NO: 3648 - protein, 42 aa, Artificial Sequence; identical to SEQ ID NO: 2599
  chemically synthesized

SEQ ID NO: 3649 - protein, 42 aa, Artificial Sequence
  chemically synthesized
SQVSPFKIPIEELEDRVFVNCNTSHYRASSLSNCKHTSSVEE

SEQ ID NO: 3650 - protein, 42 aa, Artificial Sequence
  chemically synthesized
SQVSPFKIPIEELEDRVFVNCNTSFYRASSLSNCKHTSSVEE

SEQ ID NO: 3651 - protein, 42 aa, Artificial Sequence
  chemically synthesized
SQVSPFKIPIEELEDRVFVNCNTSMYRASSLSNCKHTSSVEE

SEQ ID NO: 3652 - protein, 42 aa, Artificial Sequence
  chemically synthesized
SQVSPFKIPIEELEDRVFVNCNTSIWRASSLSNCKHTSSVEE

SEQ ID NO: 3653 - protein, 42 aa, Artificial Sequence
  chemically synthesized
SQVSPFKIPIEELEDRVFVNCNTSIFRASSLSNCKHTSSVEE

SEQ ID NO: 3654 - protein, 42 aa, Artificial Sequence
  chemically synthesized
SQVSPFKIPIEELEDRVFVNCNTSISRASSLSNCKHTSSVEE

SEQ ID NO: 3655 - protein, 42 aa, Artificial Sequence; identical to SEQ ID NO: 2717
  chemically synthesized

SEQ ID NO: 3656 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSLSNCKHTSSVEE

SEQ ID NO: 3657 - protein, 42 aa, Artificial Sequence
  chemically synthesized
SQVSPFKIPIEELEDRVFVNCNTSIYHASSLSNCKHTSSVEE

SEQ ID NO: 3658 - protein, 42 aa, Artificial Sequence; identical to SEQ ID NO: 2836
  chemically synthesized

SEQ ID NO: 3659 - protein, 42 aa, Artificial Sequence; identical to SEQ ID NO: 2957
  chemically synthesized

SEQ ID NO: 3660 - protein, 42 aa, Artificial Sequence; identical to SEQ ID NO: 3077
  chemically synthesized

SEQ ID NO: 3661 - protein, 42 aa, Artificial Sequence
  chemically synthesized
SQVSPFKIPIEELEDRVFVNCNTSIYRAYSLSNCKHTSSVEE

SEQ ID NO: 3662 - protein, 42 aa, Artificial Sequence; identical to SEQ ID NO: 3197
  chemically synthesized

SEQ ID NO: 3663 - protein, 42 aa, Artificial Sequence
  chemically synthesized
SQVSPFKIPIEELEDRVFVNCNTSIYRASYLSNCKHTSSVEE

SEQ ID NO: 3664 - protein, 42 aa, Artificial Sequence; identical to SEQ ID NO: 3314
  chemically synthesized

SEQ ID NO: 3665 - protein, 42 aa, Artificial Sequence
  chemically synthesized
SQVSPFKIPIEELEDRVFVNCNTSIYRASSVSNCKHTSSVEE

SEQ ID NO: 3666 - protein, 42 aa, Artificial Sequence
  chemically synthesized
SQVSPFKIPIEELEDRVFVNCNTSIYRASSFSNCKHTSSVEE

SEQ ID NO: 3667 - protein, 42 aa, Artificial Sequence
  chemically synthesized
SQVSPFKIPIEELEDRVFVNCNTSIYRASSMSNCKHTSSVEE

SEQ ID NO: 3668 - protein, 42 aa, Artificial Sequence
  chemically synthesized
SQVSPFKIPIEELEDRVFVNCNTSIYRASSHSNCKHTSSVEE

SEQ ID NO: 3669 - protein, 42 aa, Artificial Sequence; identical to SEQ ID NO: 3434
  chemically synthesized

SEQ ID NO: 3670 - protein, 42 aa, Artificial Sequence
  chemically synthesized
SQVSPFKIPIEELEDRVFVNCNTSIYRASSLYNCKHTSSVEE

SEQ ID NO: 3671 - protein, 42 aa, Artificial Sequence; identical to SEQ ID NO: 3555
  chemically synthesized

SEQ ID NO: 3672 - protein, 42 aa, Artificial Sequence
  chemically synthesized
SQVSPFKIPIEELEDRVFVNCNTSIYRASSLSNSKHTSSVEE

SEQ ID NO: 3673 - protein, 42 aa, Artificial Sequence
  chemically synthesized
SQVSPFKIPIEELEDRVFVNCNTSIYRASSLSNGKHTSSVEE

SEQ ID NO: 3674 - protein, 42 aa, Artificial Sequence
  chemically synthesized
SQVSPFKIPIEELEDRVFVNCNTSIYRASSLSNAKHTSSVEE

SEQ ID NO: 3675 - protein, 42 aa, Artificial Sequence
  chemically synthesized
SQVSPFKIPIEELEDRVFVNCNTSIYRASSLSNCKGTSSVEE

SEQ ID NO: 3676 - protein, 42 aa, Artificial Sequence
  chemically synthesized
SQVSPFKIPIEELEDRVFVNCNTSIYRASSLSNCKATSSVEE

SEQ ID NO: 3677 - protein, 42 aa, Artificial Sequence
  chemically synthesized
SQVSPFKIPIEELEDRVFVNCNTSIYRASSLSNCKITSSVEE

SEQ ID NO: 3678 - protein, 42 aa, Artificial Sequence
  chemically synthesized
SQVSPFKIPIEELEDRVFVNCNTSIYRASSLSNCKLTSSVEE

SEQ ID NO: 3679 - protein, 42 aa, Artificial Sequence
  chemically synthesized
SQVSPFKIPIEELEDRVFVNCNTSIYRASSLSNCKMTSSVEE

SEQ ID NO: 3680 - protein, 42 aa, Artificial Sequence
  chemically synthesized
SQVSPFKIPIEELEDRVFVNCNTSIYRASSLSNCKVTSSVEE

SEQ ID NO: 3681 - protein, 42 aa, Artificial Sequence
  chemically synthesized
SQVSPFKIPIEELEDRVFVNCNTSIYRASSLSNCKHSSSVEE

SEQ ID NO: 3682 - protein, 42 aa, Artificial Sequence
  chemically synthesized
SQVSPFKIPIEELEDRVFVNCNTSIYRASSLSNCKHYSSVEE

SEQ ID NO: 3683 - protein, 42 aa, Artificial Sequence
  chemically synthesized
SQVSPFKIPIEELEDRVFVNCNTSIYRASSLSNCKHTTSVEE

SEQ ID NO: 3684 - protein, 42 aa, Artificial Sequence
  chemically synthesized
SQVSPFKIPIEELEDRVFVNCNTSIYRASSLSNCKHTYSVEE

SEQ ID NO: 3685 - protein, 42 aa, Artificial Sequence
  chemically synthesized
SQVSPFKIPIEELEDRVFVNCNTSIYRASSLSNCKHTSTVEE

SEQ ID NO: 3686 - protein, 42 aa, Artificial Sequence
  chemically synthesized
SQVSPFKIPIEELEDRVFVNCNTSIYRASSLSNCKHTSYVEE

SEQ ID NO: 3687 - protein, 42 aa, Artificial Sequence
  chemically synthesized
SQVSPFKIPIEELEDRVFVNCNTSIYRASSLSNCKHTSSIEE

SEQ ID NO: 3688 - protein, 42 aa, Artificial Sequence
  chemically synthesized
SQVSPFKIPIEELEDRVFVNCNTSIYRASSLSNCKHTSSLEE

SEQ ID NO: 3689 - protein, 42 aa, Artificial Sequence
  chemically synthesized
SQVSPFKIPIEELEDRVFVNCNTSIYRASSLSNCKHTSSFEE

SEQ ID NO: 3690 - protein, 42 aa, Artificial Sequence
  chemically synthesized
SQVSPFKIPIEELEDRVFVNCNTSIYRASSLSNCKHTSSHEE

SEQ ID NO: 3691 - protein, 42 aa, Artificial Sequence
  chemically synthesized
SQVSPFKIPIEELEDRVFVNCNTSIYRASSLSNCKHTSSMEE

SEQ ID NO: 3692 - protein, 42 aa, Artificial Sequence
  chemically synthesized
SQVSPFKIPIEELEDRVFVNCNTSIYRASSLSNCKHTSSVDE

SEQ ID NO: 3693 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASSLSNCKHTSSVXE

SEQ ID NO: 3694 - protein, 42 aa, Artificial Sequence
  chemically synthesized
SQVSPFKIPIEELEDRVFVNCNTSIYRASSLSNCKHTSSVED

SEQ ID NO: 3695 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASSLSNCKHTSSVEX

SEQ ID NO: 3696 - protein, 42 aa, Artificial Sequence
  chemically synthesized
SQVSAFKIPIEELEDRVFVNCNTSIYRASSLSNCKHTSSVEE

SEQ ID NO: 3697 - protein, 42 aa, Artificial Sequence
  chemically synthesized
SQVSGFKIPIEELEDRVFVNCNTSIYRASSLSNCKHTSSVEE

SEQ ID NO: 3698 - protein, 42 aa, Artificial Sequence
  chemically synthesized
SQVSPFKIAIEELEDRVFVNCNTSIYRASSLSNCKHTSSVEE

SEQ ID NO: 3699 - protein, 42 aa, Artificial Sequence
  chemically synthesized
SQVSPFKIGIEELEDRVFVNCNTSIYRASSLSNCKHTSSVEE

SEQ ID NO: 3700 - protein, 42 aa, Artificial Sequence; identical to SEQ ID NO: 107
  chemically synthesized

SEQ ID NO: 3701 - protein, 42 aa, Artificial Sequence; identical to SEQ ID NO: 226
  chemically synthesized

SEQ ID NO: 3702 - protein, 42 aa, Artificial Sequence
  chemically synthesized
YQVSPFKIPIEELEDRVFVNCNTSIYRASSLSNCRHSSSVEE

SEQ ID NO: 3703 - protein, 42 aa, Artificial Sequence; identical to SEQ ID NO: 346
  chemically synthesized

SEQ ID NO: 3704 - protein, 42 aa, Artificial Sequence; identical to SEQ ID NO: 464
  chemically synthesized

SEQ ID NO: 3705 - protein, 42 aa, Artificial Sequence
  chemically synthesized
SQISPFKIPIEELEDRVFVNCNTSIYRASSLSNCRHSSSVEE

SEQ ID NO: 3706 - protein, 42 aa, Artificial Sequence
  chemically synthesized
SQPSPFKIPIEELEDRVFVNCNTSIYRASSLSNCRHSSSVEE

SEQ ID NO: 3707 - protein, 42 aa, Artificial Sequence
  chemically synthesized
SQFSPFKIPIEELEDRVFVNCNTSIYRASSLSNCRHSSSVEE

SEQ ID NO: 3708 - protein, 42 aa, Artificial Sequence; identical to SEQ ID NO: 583
  chemically synthesized

SEQ ID NO: 3709 - protein, 42 aa, Artificial Sequence
  chemically synthesized
SQVYPFKIPIEELEDRVFVNCNTSIYRASSLSNCRHSSSVEE

SEQ ID NO: 3710 - protein, 42 aa, Artificial Sequence
  chemically synthesized
SQVSPWKIPIEELEDRVFVNCNTSIYRASSLSNCRHSSSVEE

SEQ ID NO: 3711 - protein, 42 aa, Artificial Sequence
  chemically synthesized
SQVSPYKIPIEELEDRVFVNCNTSIYRASSLSNCRHSSSVEE

SEQ ID NO: 3712 - protein, 42 aa, Artificial Sequence
  chemically synthesized
SQVSPHKIPIEELEDRVFVNCNTSIYRASSLSNCRHSSSVEE

SEQ ID NO: 3713 - protein, 42 aa, Artificial Sequence
  chemically synthesized
SQVSPFRIPIEELEDRVFVNCNTSIYRASSLSNCRHSSSVEE

SEQ ID NO: 3714 - protein, 42 aa, Artificial Sequence
  chemically synthesized
SQVSPFHIPIEELEDRVFVNCNTSIYRASSLSNCRHSSSVEE

SEQ ID NO: 3715 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSLSNCRHSSSVEE

SEQ ID NO: 3716 - protein, 42 aa, Artificial Sequence; identical to SEQ ID NO: 822
  chemically synthesized

SEQ ID NO: 3717 - protein, 42 aa, Artificial Sequence
  chemically synthesized
SQVSPFKHPIEELEDRVFVNCNTSIYRASSLSNCRHSSSVEE

SEQ ID NO: 3718 - protein, 42 aa, Artificial Sequence
  chemically synthesized
SQVSPFKVPIEELEDRVFVNCNTSIYRASSLSNCRHSSSVEE

SEQ ID NO: 3719 - protein, 42 aa, Artificial Sequence
  chemically synthesized
SQVSPFKFPIEELEDRVFVNCNTSIYRASSLSNCRHSSSVEE

SEQ ID NO: 3720 - protein, 42 aa, Artificial Sequence
  chemically synthesized
SQVSPFKMPIEELEDRVFVNCNTSIYRASSLSNCRHSSSVEE

SEQ ID NO: 3721 - protein, 42 aa, Artificial Sequence; identical to SEQ ID NO: 940
  chemically synthesized

SEQ ID NO: 3722 - protein, 42 aa, Artificial Sequence
  chemically synthesized
SQVSPFKIPHEELEDRVFVNCNTSIYRASSLSNCRHSSSVEE

SEQ ID NO: 3723 - protein, 42 aa, Artificial Sequence
  chemically synthesized
SQVSPFKIPVEELEDRVFVNCNTSIYRASSLSNCRHSSSVEE

SEQ ID NO: 3724 - protein, 42 aa, Artificial Sequence
  chemically synthesized
SQVSPFKIPFEELEDRVFVNCNTSIYRASSLSNCRHSSSVEE

SEQ ID NO: 3725 - protein, 42 aa, Artificial Sequence
  chemically synthesized
SQVSPFKIPMEELEDRVFVNCNTSIYRASSLSNCRHSSSVEE

SEQ ID NO: 3726 - protein, 42 aa, Artificial Sequence; identical to SEQ ID NO: 1060
  chemically synthesized

SEQ ID NO: 3727 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSLSNCRHSSSVEE

SEQ ID NO: 3728 - protein, 42 aa, Artificial Sequence; identical to SEQ ID NO: 1180
  chemically synthesized

SEQ ID NO: 3729 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSLSNCRHSSSVEE

SEQ ID NO: 3730 - protein, 42 aa, Artificial Sequence
  chemically synthesized
SQVSPFKIPIEEVEDRVFVNCNTSIYRASSLSNCRHSSSVEE

SEQ ID NO: 3731 - protein, 42 aa, Artificial Sequence; identical to SEQ ID NO: 1297
  chemically synthesized

SEQ ID NO: 3732 - protein, 42 aa, Artificial Sequence
  chemically synthesized
SQVSPFKIPIEEFEDRVFVNCNTSIYRASSLSNCRHSSSVEE

SEQ ID NO: 3733 - protein, 42 aa, Artificial Sequence
  chemically synthesized
SQVSPFKIPIEEHEDRVFVNCNTSIYRASSLSNCRHSSSVEE

SEQ ID NO: 3734 - protein, 42 aa, Artificial Sequence
  chemically synthesized
SQVSPFKIPIEEMEDRVFVNCNTSIYRASSLSNCRHSSSVEE

SEQ ID NO: 3735 - protein, 42 aa, Artificial Sequence; identical to SEQ ID NO: 1417
  chemically synthesized

SEQ ID NO: 3736 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASSLSNCRHSSSVEE

SEQ ID NO: 3737 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSLSNCRHSSSVEE

SEQ ID NO: 3738 - protein, 42 aa, Artificial Sequence
  chemically synthesized
SQVSPFKIPIEELEERVFVNCNTSIYRASSLSNCRHSSSVEE

SEQ ID NO: 3739 - protein, 42 aa, Artificial Sequence; identical to SEQ ID NO: 1536
  chemically synthesized

SEQ ID NO: 3740 - protein, 42 aa, Artificial Sequence
  chemically synthesized
SQVSPFKIPIEELEDHVFVNCNTSIYRASSLSNCRHSSSVEE

SEQ ID NO: 3741 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSLSNCRHSSSVEE

SEQ ID NO: 3742 - protein, 42 aa, Artificial Sequence; identical to SEQ ID NO: 1653
  chemically synthesized

SEQ ID NO: 3743 - protein, 42 aa, Artificial Sequence
  chemically synthesized
SQVSPFKIPIEELEDRLFVNCNTSIYRASSLSNCRHSSSVEE

SEQ ID NO: 3744 - protein, 42 aa, Artificial Sequence
  chemically synthesized
SQVSPFKIPIEELEDRFFVNCNTSIYRASSLSNCRHSSSVEE

SEQ ID NO: 3745 - protein, 42 aa, Artificial Sequence
  chemically synthesized
SQVSPFKIPIEELEDRHFVNCNTSIYRASSLSNCRHSSSVEE

SEQ ID NO: 3746 - protein, 42 aa, Artificial Sequence
  chemically synthesized
SQVSPFKIPIEELEDRMFVNCNTSIYRASSLSNCRHSSSVEE

SEQ ID NO: 3747 - protein, 42 aa, Artificial Sequence; identical to SEQ ID NO: 1770
  chemically synthesized

SEQ ID NO: 3748 - protein, 42 aa, Artificial Sequence
  chemically synthesized
SQVSPFKIPIEELEDRVLVNCNTSIYRASSLSNCRHSSSVEE

SEQ ID NO: 3749 - protein, 42 aa, Artificial Sequence
  chemically synthesized
SQVSPFKIPIEELEDRVVVNCNTSIYRASSLSNCRHSSSVEE

SEQ ID NO: 3750 - protein, 42 aa, Artificial Sequence
  chemically synthesized
SQVSPFKIPIEELEDRVHVNCNTSIYRASSLSNCRHSSSVEE

SEQ ID NO: 3751 - protein, 42 aa, Artificial Sequence
  chemically synthesized
SQVSPFKIPIEELEDRVMVNCNTSIYRASSLSNCRHSSSVEE

SEQ ID NO: 3752 - protein, 42 aa, Artificial Sequence; identical to SEQ ID NO: 1887
  chemically synthesized

SEQ ID NO: 3753 - protein, 42 aa, Artificial Sequence
  chemically synthesized
SQVSPFKIPIEELEDRVFLNCNTSIYRASSLSNCRHSSSVEE

SEQ ID NO: 3754 - protein, 42 aa, Artificial Sequence
  chemically synthesized
SQVSPFKIPIEELEDRVFFNCNTSIYRASSLSNCRHSSSVEE

SEQ ID NO: 3755 - protein, 42 aa, Artificial Sequence
  chemically synthesized
SQVSPFKIPIEELEDRVFHNCNTSIYRASSLSNCRHSSSVEE

SEQ ID NO: 3756 - protein, 42 aa, Artificial Sequence
  chemically synthesized
SQVSPFKIPIEELEDRVFMNCNTSIYRASSLSNCRHSSSVEE

SEQ ID NO: 3757 - protein, 42 aa, Artificial Sequence; identical to SEQ ID NO: 2008
  chemically synthesized

SEQ ID NO: 3758 - protein, 42 aa, Artificial Sequence
  chemically synthesized
SQVSPFKIPIEELEDRVFVNSNTSIYRASSLSNCRHSSSVEE

SEQ ID NO: 3759 - protein, 42 aa, Artificial Sequence
  chemically synthesized
SQVSPFKIPIEELEDRVFVNGNTSIYRASSLSNCRHSSSVEE

SEQ ID NO: 3760 - protein, 42 aa, Artificial Sequence
  chemically synthesized
SQVSPFKIPIEELEDRVFVNANTSIYRASSLSNCRHSSSVEE

SEQ ID NO: 3761 - protein, 42 aa, Artificial Sequence; identical to SEQ ID NO: 2249
  chemically synthesized

SEQ ID NO: 3762 - protein, 42 aa, Artificial Sequence; identical to SEQ ID NO: 2369
  chemically synthesized

SEQ ID NO: 3763 - protein, 42 aa, Artificial Sequence
  chemically synthesized
SQVSPFKIPIEELEDRVFVNCNYSIYRASSLSNCRHSSSVEE

SEQ ID NO: 3764 - protein, 42 aa, Artificial Sequence; identical to SEQ ID NO: 2489
  chemically synthesized

SEQ ID NO: 3765 - protein, 42 aa, Artificial Sequence
  chemically synthesized
SQVSPFKIPIEELEDRVFVNCNTYIYRASSLSNCRHSSSVEE

SEQ ID NO: 3766 - protein, 42 aa, Artificial Sequence
  chemically synthesized
SQVSPFKIPIEELEDRVFVNCNTSVYRASSLSNCRHSSSVEE

SEQ ID NO: 3767 - protein, 42 aa, Artificial Sequence; identical to SEQ ID NO: 2606
  chemically synthesized

SEQ ID NO: 3768 - protein, 42 aa, Artificial Sequence
  chemically synthesized
SQVSPFKIPIEELEDRVFVNCNTSHYRASSLSNCRHSSSVEE

SEQ ID NO: 3769 - protein, 42 aa, Artificial Sequence
  chemically synthesized
SQVSPFKIPIEELEDRVFVNCNTSFYRASSLSNCRHSSSVEE

SEQ ID NO: 3770 - protein, 42 aa, Artificial Sequence
  chemically synthesized
SQVSPFKIPIEELEDRVFVNCNTSMYRASSLSNCRHSSSVEE

SEQ ID NO: 3771 - protein, 42 aa, Artificial Sequence
  chemically synthesized
SQVSPFKIPIEELEDRVFVNCNTSIWRASSLSNCRHSSSVEE

SEQ ID NO: 3772 - protein, 42 aa, Artificial Sequence
  chemically synthesized
SQVSPFKIPIEELEDRVFVNCNTSIFRASSLSNCRHSSSVEE

SEQ ID NO: 3773 - protein, 42 aa, Artificial Sequence
  chemically synthesized
SQVSPFKIPIEELEDRVFVNCNTSISRASSLSNCRHSSSVEE

SEQ ID NO: 3774 - protein, 42 aa, Artificial Sequence; identical to SEQ ID NO: 2724
  chemically synthesized

SEQ ID NO: 3775 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSLSNCRHSSSVEE

SEQ ID NO: 3776 - protein, 42 aa, Artificial Sequence
  chemically synthesized
SQVSPFKIPIEELEDRVFVNCNTSIYHASSLSNCRHSSSVEE

SEQ ID NO: 3777 - protein, 42 aa, Artificial Sequence; identical to SEQ ID NO: 2843
  chemically synthesized

SEQ ID NO: 3778 - protein, 42 aa, Artificial Sequence; identical to SEQ ID NO: 2964
  chemically synthesized

SEQ ID NO: 3779 - protein, 42 aa, Artificial Sequence; identical to SEQ ID NO: 3084
  chemically synthesized

SEQ ID NO: 3780 - protein, 42 aa, Artificial Sequence
  chemically synthesized
SQVSPFKIPIEELEDRVFVNCNTSIYRAYSLSNCRHSSSVEE

SEQ ID NO: 3781 - protein, 42 aa, Artificial Sequence; identical to SEQ ID NO: 3204
  chemically synthesized

SEQ ID NO: 3782 - protein, 42 aa, Artificial Sequence
  chemically synthesized
SQVSPFKIPIEELEDRVFVNCNTSIYRASYLSNCRHSSSVEE

SEQ ID NO: 3783 - protein, 42 aa, Artificial Sequence; identical to SEQ ID NO: 3321
  chemically synthesized

SEQ ID NO: 3784 - protein, 42 aa, Artificial Sequence
  chemically synthesized
SQVSPFKIPIEELEDRVFVNCNTSIYRASSVSNCRHSSSVEE

SEQ ID NO: 3785 - protein, 42 aa, Artificial Sequence
  chemically synthesized
SQVSPFKIPIEELEDRVFVNCNTSIYRASSFSNCRHSSSVEE

SEQ ID NO: 3786 - protein, 42 aa, Artificial Sequence
  chemically synthesized
SQVSPFKIPIEELEDRVFVNCNTSIYRASSMSNCRHSSSVEE

SEQ ID NO: 3787 - protein, 42 aa, Artificial Sequence
  chemically synthesized
SQVSPFKIPIEELEDRVFVNCNTSIYRASSHSNCRHSSSVEE

SEQ ID NO: 3788 - protein, 42 aa, Artificial Sequence; identical to SEQ ID NO: 3441
  chemically synthesized

SEQ ID NO: 3789 - protein, 42 aa, Artificial Sequence
  chemically synthesized
SQVSPFKIPIEELEDRVFVNCNTSIYRASSLYNCRHSSSVEE

SEQ ID NO: 3790 - protein, 42 aa, Artificial Sequence; identical to SEQ ID NO: 3562
  chemically synthesized

SEQ ID NO: 3791 - protein, 42 aa, Artificial Sequence
  chemically synthesized
SQVSPFKIPIEELEDRVFVNCNTSIYRASSLSNSRHSSSVEE

SEQ ID NO: 3792 - protein, 42 aa, Artificial Sequence
  chemically synthesized
SQVSPFKIPIEELEDRVFVNCNTSIYRASSLSNGRHSSSVEE

SEQ ID NO: 3793 - protein, 42 aa, Artificial Sequence
  chemically synthesized
SQVSPFKIPIEELEDRVFVNCNTSIYRASSLSNARHSSSVEE

SEQ ID NO: 3794 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRASSLSNCXHSSSVEE

SEQ ID NO: 3795 - protein, 42 aa, Artificial Sequence
  chemically synthesized
SQVSPFKIPIEELEDRVFVNCNTSIYRASSLSNCHHSSSVEE

SEQ ID NO: 3796 - protein, 42 aa, Artificial Sequence; identical to SEQ ID NO: 3681
  chemically synthesized

SEQ ID NO: 3797 - protein, 42 aa, Artificial Sequence
  chemically synthesized
SQVSPFKIPIEELEDRVFVNCNTSIYRASSLSNCRGSSSVEE

SEQ ID NO: 3798 - protein, 42 aa, Artificial Sequence
  chemically synthesized
SQVSPFKIPIEELEDRVFVNCNTSIYRASSLSNCRASSSVEE

SEQ ID NO: 3799 - protein, 42 aa, Artificial Sequence
  chemically synthesized
SQVSPFKIPIEELEDRVFVNCNTSIYRASSLSNCRISSSVEE

SEQ ID NO: 3800 - protein, 42 aa, Artificial Sequence
  chemically synthesized
SQVSPFKIPIEELEDRVFVNCNTSIYRASSLSNCRLSSSVEE

SEQ ID NO: 3801 - protein, 42 aa, Artificial Sequence
  chemically synthesized
SQVSPFKIPIEELEDRVFVNCNTSIYRASSLSNCRMSSSVEE

SEQ ID NO: 3802 - protein, 42 aa, Artificial Sequence
  chemically synthesized
SQVSPFKIPIEELEDRVFVNCNTSIYRASSLSNCRVSSSVEE

SEQ ID NO: 3803 - protein, 42 aa, Artificial Sequence
  chemically synthesized
SQVSPFKIPIEELEDRVFVNCNTSIYRASSLSNCRHSTSVEE

SEQ ID NO: 3804 - protein, 42 aa, Artificial Sequence
  chemically synthesized
SQVSPFKIPIEELEDRVFVNCNTSIYRASSLSNCRHSYSVEE

SEQ ID NO: 3805 - protein, 42 aa, Artificial Sequence
  chemically synthesized
SQVSPFKIPIEELEDRVFVNCNTSIYRASSLSNCRHSSTVEE

SEQ ID NO: 3806 - protein, 42 aa, Artificial Sequence
  chemically synthesized
SQVSPFKIPIEELEDRVFVNCNTSIYRASSLSNCRHSSYVEE

SEQ ID NO: 3807 - protein, 42 aa, Artificial Sequence
  chemically synthesized
SQVSPFKIPIEELEDRVFVNCNTSIYRASSLSNCRHSSSIEE

SEQ ID NO: 3808 - protein, 42 aa, Artificial Sequence
  chemically synthesized
SQVSPFKIPIEELEDRVFVNCNTSIYRASSLSNCRHSSSLEE

SEQ ID NO: 3809 - protein, 42 aa, Artificial Sequence
  chemically synthesized
SQVSPFKIPIEELEDRVFVNCNTSIYRASSLSNCRHSSSFEE

SEQ ID NO: 3810 - protein, 42 aa, Artificial Sequence
  chemically synthesized
SQVSPFKIPIEELEDRVFVNCNTSIYRASSLSNCRHSSSHEE

SEQ ID NO: 3811 - protein, 42 aa, Artificial Sequence
  chemically synthesized
SQVSPFKIPIEELEDRVFVNCNTSIYRASSLSNCRHSSSMEE

SEQ ID NO: 3812 - protein, 42 aa, Artificial Sequence
  chemically synthesized
SQVSPFKIPIEELEDRVFVNCNTSIYRASSLSNCRHSSSVDE

SEQ ID NO: 3813 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASSLSNCRHSSSVXE

SEQ ID NO: 3814 - protein, 42 aa, Artificial Sequence
  chemically synthesized
SQVSPFKIPIEELEDRVFVNCNTSIYRASSLSNCRHSSSVED

SEQ ID NO: 3815 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASSLSNCRHSSSVEX

SEQ ID NO: 3816 - protein, 42 aa, Artificial Sequence
  chemically synthesized
SQVSAFKIPIEELEDRVFVNCNTSIYRASSLSNCRHSSSVEE

SEQ ID NO: 3817 - protein, 42 aa, Artificial Sequence
  chemically synthesized
SQVSGFKIPIEELEDRVFVNCNTSIYRASSLSNCRHSSSVEE

SEQ ID NO: 3818 - protein, 42 aa, Artificial Sequence
  chemically synthesized
SQVSPFKIAIEELEDRVFVNCNTSIYRASSLSNCRHSSSVEE

SEQ ID NO: 3819 - protein, 42 aa, Artificial Sequence
  chemically synthesized
SQVSPFKIGIEELEDRVFVNCNTSIYRASSLSNCRHSSSVEE

SEQ ID NO: 3820 - protein, 42 aa, Artificial Sequence; identical to SEQ ID NO: 109
  chemically synthesized

SEQ ID NO: 3821 - protein, 42 aa, Artificial Sequence; identical to SEQ ID NO: 228
  chemically synthesized

SEQ ID NO: 3822 - protein, 42 aa, Artificial Sequence
  chemically synthesized
YQVSPFKIPIEELEDRVFVNCNTSIYRASSLSNCRHTTSVEE

SEQ ID NO: 3823 - protein, 42 aa, Artificial Sequence; identical to SEQ ID NO: 348
  chemically synthesized

SEQ ID NO: 3824 - protein, 42 aa, Artificial Sequence; identical to SEQ ID NO: 466
  chemically synthesized

SEQ ID NO: 3825 - protein, 42 aa, Artificial Sequence
  chemically synthesized
SQISPFKIPIEELEDRVFVNCNTSIYRASSLSNCRHTTSVEE

SEQ ID NO: 3826 - protein, 42 aa, Artificial Sequence
  chemically synthesized
SQPSPFKIPIEELEDRVFVNCNTSIYRASSLSNCRHTTSVEE

SEQ ID NO: 3827 - protein, 42 aa, Artificial Sequence
  chemically synthesized
SQFSPFKIPIEELEDRVFVNCNTSIYRASSLSNCRHTTSVEE

SEQ ID NO: 3828 - protein, 42 aa, Artificial Sequence; identical to SEQ ID NO: 585
  chemically synthesized

SEQ ID NO: 3829 - protein, 42 aa, Artificial Sequence
  chemically synthesized
SQVYPFKIPIEELEDRVFVNCNTSIYRASSLSNCRHTTSVEE

SEQ ID NO: 3830 - protein, 42 aa, Artificial Sequence
  chemically synthesized
SQVSPWKIPIEELEDRVFVNCNTSIYRASSLSNCRHTTSVEE

SEQ ID NO: 3831 - protein, 42 aa, Artificial Sequence
  chemically synthesized
SQVSPYKIPIEELEDRVFVNCNTSIYRASSLSNCRHTTSVEE

SEQ ID NO: 3832 - protein, 42 aa, Artificial Sequence
  chemically synthesized
SQVSPHKIPIEELEDRVFVNCNTSIYRASSLSNCRHTTSVEE

SEQ ID NO: 3833 - protein, 42 aa, Artificial Sequence
  chemically synthesized
SQVSPFRIPIEELEDRVFVNCNTSIYRASSLSNCRHTTSVEE

SEQ ID NO: 3834 - protein, 42 aa, Artificial Sequence
  chemically synthesized
SQVSPFHIPIEELEDRVFVNCNTSIYRASSLSNCRHTTSVEE

SEQ ID NO: 3835 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSLSNCRHTTSVEE

SEQ ID NO: 3836 - protein, 42 aa, Artificial Sequence; identical to SEQ ID NO: 824
  chemically synthesized

SEQ ID NO: 3837 - protein, 42 aa, Artificial Sequence
  chemically synthesized
SQVSPFKHPIEELEDRVFVNCNTSIYRASSLSNCRHTTSVEE

SEQ ID NO: 3838 - protein, 42 aa, Artificial Sequence
  chemically synthesized
SQVSPFKVPIEELEDRVFVNCNTSIYRASSLSNCRHTTSVEE

SEQ ID NO: 3839 - protein, 42 aa, Artificial Sequence
  chemically synthesized
SQVSPFKFPIEELEDRVFVNCNTSIYRASSLSNCRHTTSVEE

SEQ ID NO: 3840 - protein, 42 aa, Artificial Sequence
  chemically synthesized
SQVSPFKMPIEELEDRVFVNCNTSIYRASSLSNCRHTTSVEE

SEQ ID NO: 3841 - protein, 42 aa, Artificial Sequence; identical to SEQ ID NO: 942
  chemically synthesized

SEQ ID NO: 3842 - protein, 42 aa, Artificial Sequence
  chemically synthesized
SQVSPFKIPHEELEDRVFVNCNTSIYRASSLSNCRHTTSVEE

SEQ ID NO: 3843 - protein, 42 aa, Artificial Sequence
  chemically synthesized
SQVSPFKIPVEELEDRVFVNCNTSIYRASSLSNCRHTTSVEE

SEQ ID NO: 3844 - protein, 42 aa, Artificial Sequence
  chemically synthesized
SQVSPFKIPFEELEDRVFVNCNTSIYRASSLSNCRHTTSVEE

SEQ ID NO: 3845 - protein, 42 aa, Artificial Sequence
  chemically synthesized
SQVSPFKIPMEELEDRVFVNCNTSIYRASSLSNCRHTTSVEE

SEQ ID NO: 3846 - protein, 42 aa, Artificial Sequence; identical to SEQ ID NO: 1062
  chemically synthesized

SEQ ID NO: 3847 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSLSNCRHTTSVEE

SEQ ID NO: 3848 - protein, 42 aa, Artificial Sequence; identical to SEQ ID NO: 1182
  chemically synthesized

SEQ ID NO: 3849 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSLSNCRHTTSVEE

SEQ ID NO: 3850 - protein, 42 aa, Artificial Sequence
  chemically synthesized
SQVSPFKIPIEEVEDRVFVNCNTSIYRASSLSNCRHTTSVEE

SEQ ID NO: 3851 - protein, 42 aa, Artificial Sequence; identical to SEQ ID NO: 1299
  chemically synthesized

SEQ ID NO: 3852 - protein, 42 aa, Artificial Sequence
  chemically synthesized
SQVSPFKIPIEEFEDRVFVNCNTSIYRASSLSNCRHTTSVEE

SEQ ID NO: 3853 - protein, 42 aa, Artificial Sequence
  chemically synthesized
SQVSPFKIPIEEHEDRVFVNCNTSIYRASSLSNCRHTTSVEE

SEQ ID NO: 3854 - protein, 42 aa, Artificial Sequence
  chemically synthesized
SQVSPFKIPIEEMEDRVFVNCNTSIYRASSLSNCRHTTSVEE

SEQ ID NO: 3855 - protein, 42 aa, Artificial Sequence; identical to SEQ ID NO: 1419
  chemically synthesized

SEQ ID NO: 3856 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASSLSNCRHTTSVEE

SEQ ID NO: 3857 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSLSNCRHTTSVEE

SEQ ID NO: 3858 - protein, 42 aa, Artificial Sequence
  chemically synthesized
SQVSPFKIPIEELEERVFVNCNTSIYRASSLSNCRHTTSVEE

SEQ ID NO: 3859 - protein, 42 aa, Artificial Sequence; identical to SEQ ID NO: 1538
  chemically synthesized

SEQ ID NO: 3860 - protein, 42 aa, Artificial Sequence
  chemically synthesized
SQVSPFKIPIEELEDHVFVNCNTSIYRASSLSNCRHTTSVEE

SEQ ID NO: 3861 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSLSNCRHTTSVEE

SEQ ID NO: 3862 - protein, 42 aa, Artificial Sequence; identical to SEQ ID NO: 1655
  chemically synthesized

SEQ ID NO: 3863 - protein, 42 aa, Artificial Sequence
  chemically synthesized
SQVSPFKIPIEELEDRLFVNCNTSIYRASSLSNCRHTTSVEE

SEQ ID NO: 3864 - protein, 42 aa, Artificial Sequence
  chemically synthesized
SQVSPFKIPIEELEDRFFVNCNTSIYRASSLSNCRHTTSVEE

SEQ ID NO: 3865 - protein, 42 aa, Artificial Sequence
  chemically synthesized
SQVSPFKIPIEELEDRHFVNCNTSIYRASSLSNCRHTTSVEE

SEQ ID NO: 3866 - protein, 42 aa, Artificial Sequence
  chemically synthesized
SQVSPFKIPIEELEDRMFVNCNTSIYRASSLSNCRHTTSVEE

SEQ ID NO: 3867 - protein, 42 aa, Artificial Sequence; identical to SEQ ID NO: 1772
  chemically synthesized

SEQ ID NO: 3868 - protein, 42 aa, Artificial Sequence
  chemically synthesized
SQVSPFKIPIEELEDRVLVNCNTSIYRASSLSNCRHTTSVEE

SEQ ID NO: 3869 - protein, 42 aa, Artificial Sequence
  chemically synthesized
SQVSPFKIPIEELEDRVVVNCNTSIYRASSLSNCRHTTSVEE

SEQ ID NO: 3870 - protein, 42 aa, Artificial Sequence
  chemically synthesized
SQVSPFKIPIEELEDRVHVNCNTSIYRASSLSNCRHTTSVEE

SEQ ID NO: 3871 - protein, 42 aa, Artificial Sequence
  chemically synthesized
SQVSPFKIPIEELEDRVMVNCNTSIYRASSLSNCRHTTSVEE

SEQ ID NO: 3872 - protein, 42 aa, Artificial Sequence; identical to SEQ ID NO: 1889
  chemically synthesized

SEQ ID NO: 3873 - protein, 42 aa, Artificial Sequence
  chemically synthesized
SQVSPFKIPIEELEDRVFLNCNTSIYRASSLSNCRHTTSVEE

SEQ ID NO: 3874 - protein, 42 aa, Artificial Sequence
  chemically synthesized
SQVSPFKIPIEELEDRVFFNCNTSIYRASSLSNCRHTTSVEE

SEQ ID NO: 3875 - protein, 42 aa, Artificial Sequence
  chemically synthesized
SQVSPFKIPIEELEDRVFHNCNTSIYRASSLSNCRHTTSVEE

SEQ ID NO: 3876 - protein, 42 aa, Artificial Sequence
  chemically synthesized
SQVSPFKIPIEELEDRVFMNCNTSIYRASSLSNCRHTTSVEE

SEQ ID NO: 3877 - protein, 42 aa, Artificial Sequence; identical to SEQ ID NO: 2010
  chemically synthesized

SEQ ID NO: 3878 - protein, 42 aa, Artificial Sequence
  chemically synthesized
SQVSPFKIPIEELEDRVFVNSNTSIYRASSLSNCRHTTSVEE

SEQ ID NO: 3879 - protein, 42 aa, Artificial Sequence
  chemically synthesized
SQVSPFKIPIEELEDRVFVNGNTSIYRASSLSNCRHTTSVEE

SEQ ID NO: 3880 - protein, 42 aa, Artificial Sequence
  chemically synthesized
SQVSPFKIPIEELEDRVFVNANTSIYRASSLSNCRHTTSVEE

SEQ ID NO: 3881 - protein, 42 aa, Artificial Sequence; identical to SEQ ID NO: 2251
  chemically synthesized

SEQ ID NO: 3882 - protein, 42 aa, Artificial Sequence; identical to SEQ ID NO: 2371
  chemically synthesized

SEQ ID NO: 3883 - protein, 42 aa, Artificial Sequence
  chemically synthesized
SQVSPFKIPIEELEDRVFVNCNYSIYRASSLSNCRHTTSVEE

SEQ ID NO: 3884 - protein, 42 aa, Artificial Sequence; identical to SEQ ID NO: 2491
  chemically synthesized

SEQ ID NO: 3885 - protein, 42 aa, Artificial Sequence
  chemically synthesized
SQVSPFKIPIEELEDRVFVNCNTYIYRASSLSNCRHTTSVEE

SEQ ID NO: 3886 - protein, 42 aa, Artificial Sequence
  chemically synthesized
SQVSPFKIPIEELEDRVFVNCNTSVYRASSLSNCRHTTSVEE

SEQ ID NO: 3887 - protein, 42 aa, Artificial Sequence; identical to SEQ ID NO: 2608
  chemically synthesized

SEQ ID NO: 3888 - protein, 42 aa, Artificial Sequence
  chemically synthesized
SQVSPFKIPIEELEDRVFVNCNTSHYRASSLSNCRHTTSVEE

SEQ ID NO: 3889 - protein, 42 aa, Artificial Sequence
  chemically synthesized
SQVSPFKIPIEELEDRVFVNCNTSFYRASSLSNCRHTTSVEE

SEQ ID NO: 3890 - protein, 42 aa, Artificial Sequence
  chemically synthesized
SQVSPFKIPIEELEDRVFVNCNTSMYRASSLSNCRHTTSVEE

SEQ ID NO: 3891 - protein, 42 aa, Artificial Sequence
  chemically synthesized
SQVSPFKIPIEELEDRVFVNCNTSIWRASSLSNCRHTTSVEE

SEQ ID NO: 3892 - protein, 42 aa, Artificial Sequence
  chemically synthesized
SQVSPFKIPIEELEDRVFVNCNTSIFRASSLSNCRHTTSVEE

SEQ ID NO: 3893 - protein, 42 aa, Artificial Sequence
  chemically synthesized
SQVSPFKIPIEELEDRVFVNCNTSISRASSLSNCRHTTSVEE

SEQ ID NO: 3894 - protein, 42 aa, Artificial Sequence; identical to SEQ ID NO: 2726
  chemically synthesized

SEQ ID NO: 3895 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSLSNCRHTTSVEE

SEQ ID NO: 3896 - protein, 42 aa, Artificial Sequence
  chemically synthesized
SQVSPFKIPIEELEDRVFVNCNTSIYHASSLSNCRHTTSVEE

SEQ ID NO: 3897 - protein, 42 aa, Artificial Sequence; identical to SEQ ID NO: 2845
  chemically synthesized

SEQ ID NO: 3898 - protein, 42 aa, Artificial Sequence; identical to SEQ ID NO: 2966
  chemically synthesized

SEQ ID NO: 3899 - protein, 42 aa, Artificial Sequence; identical to SEQ ID NO: 3086
  chemically synthesized

SEQ ID NO: 3900 - protein, 42 aa, Artificial Sequence
  chemically synthesized
SQVSPFKIPIEELEDRVFVNCNTSIYRAYSLSNCRHTTSVEE

SEQ ID NO: 3901 - protein, 42 aa, Artificial Sequence; identical to SEQ ID NO: 3206
  chemically synthesized

SEQ ID NO: 3902 - protein, 42 aa, Artificial Sequence
  chemically synthesized
SQVSPFKIPIEELEDRVFVNCNTSIYRASYLSNCRHTTSVEE

SEQ ID NO: 3903 - protein, 42 aa, Artificial Sequence; identical to SEQ ID NO: 3323
  chemically synthesized

SEQ ID NO: 3904 - protein, 42 aa, Artificial Sequence
  chemically synthesized
SQVSPFKIPIEELEDRVFVNCNTSIYRASSVSNCRHTTSVEE

SEQ ID NO: 3905 - protein, 42 aa, Artificial Sequence
  chemically synthesized
SQVSPFKIPIEELEDRVFVNCNTSIYRASSFSNCRHTTSVEE

SEQ ID NO: 3906 - protein, 42 aa, Artificial Sequence
  chemically synthesized
SQVSPFKIPIEELEDRVFVNCNTSIYRASSMSNCRHTTSVEE

SEQ ID NO: 3907 - protein, 42 aa, Artificial Sequence
  chemically synthesized
SQVSPFKIPIEELEDRVFVNCNTSIYRASSHSNCRHTTSVEE

SEQ ID NO: 3908 - protein, 42 aa, Artificial Sequence; identical to SEQ ID NO: 3443
  chemically synthesized

SEQ ID NO: 3909 - protein, 42 aa, Artificial Sequence
  chemically synthesized
SQVSPFKIPIEELEDRVFVNCNTSIYRASSLYNCRHTTSVEE

SEQ ID NO: 3910 - protein, 42 aa, Artificial Sequence; identical to SEQ ID NO: 3564
  chemically synthesized

SEQ ID NO: 3911 - protein, 42 aa, Artificial Sequence
  chemically synthesized
SQVSPFKIPIEELEDRVFVNCNTSIYRASSLSNSRHTTSVEE

SEQ ID NO: 3912 - protein, 42 aa, Artificial Sequence
  chemically synthesized
SQVSPFKIPIEELEDRVFVNCNTSIYRASSLSNGRHTTSVEE

SEQ ID NO: 3913 - protein, 42 aa, Artificial Sequence
  chemically synthesized
SQVSPFKIPIEELEDRVFVNCNTSIYRASSLSNARHTTSVEE

SEQ ID NO: 3914 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRASSLSNCXHTTSVEE

SEQ ID NO: 3915 - protein, 42 aa, Artificial Sequence
  chemically synthesized
SQVSPFKIPIEELEDRVFVNCNTSIYRASSLSNCHHTTSVEE

SEQ ID NO: 3916 - protein, 42 aa, Artificial Sequence; identical to SEQ ID NO: 3683
  chemically synthesized

SEQ ID NO: 3917 - protein, 42 aa, Artificial Sequence
  chemically synthesized
SQVSPFKIPIEELEDRVFVNCNTSIYRASSLSNCRGTTSVEE

SEQ ID NO: 3918 - protein, 42 aa, Artificial Sequence
  chemically synthesized
SQVSPFKIPIEELEDRVFVNCNTSIYRASSLSNCRATTSVEE

SEQ ID NO: 3919 - protein, 42 aa, Artificial Sequence
  chemically synthesized
SQVSPFKIPIEELEDRVFVNCNTSIYRASSLSNCRITTSVEE

SEQ ID NO: 3920 - protein, 42 aa, Artificial Sequence
  chemically synthesized
SQVSPFKIPIEELEDRVFVNCNTSIYRASSLSNCRLTTSVEE

SEQ ID NO: 3921 - protein, 42 aa, Artificial Sequence
  chemically synthesized
SQVSPFKIPIEELEDRVFVNCNTSIYRASSLSNCRMTTSVEE

SEQ ID NO: 3922 - protein, 42 aa, Artificial Sequence
  chemically synthesized
SQVSPFKIPIEELEDRVFVNCNTSIYRASSLSNCRVTTSVEE

SEQ ID NO: 3923 - protein, 42 aa, Artificial Sequence; identical to SEQ ID NO: 3803
  chemically synthesized

SEQ ID NO: 3924 - protein, 42 aa, Artificial Sequence
  chemically synthesized
SQVSPFKIPIEELEDRVFVNCNTSIYRASSLSNCRHYTSVEE

SEQ ID NO: 3925 - protein, 42 aa, Artificial Sequence
  chemically synthesized
SQVSPFKIPIEELEDRVFVNCNTSIYRASSLSNCRHTTTVEE

SEQ ID NO: 3926 - protein, 42 aa, Artificial Sequence
  chemically synthesized
SQVSPFKIPIEELEDRVFVNCNTSIYRASSLSNCRHTTYVEE

SEQ ID NO: 3927 - protein, 42 aa, Artificial Sequence
  chemically synthesized
SQVSPFKIPIEELEDRVFVNCNTSIYRASSLSNCRHTTSIEE

SEQ ID NO: 3928 - protein, 42 aa, Artificial Sequence
  chemically synthesized
SQVSPFKIPIEELEDRVFVNCNTSIYRASSLSNCRHTTSLEE

SEQ ID NO: 3929 - protein, 42 aa, Artificial Sequence
  chemically synthesized
SQVSPFKIPIEELEDRVFVNCNTSIYRASSLSNCRHTTSFEE

SEQ ID NO: 3930 - protein, 42 aa, Artificial Sequence
  chemically synthesized
SQVSPFKIPIEELEDRVFVNCNTSIYRASSLSNCRHTTSHEE

SEQ ID NO: 3931 - protein, 42 aa, Artificial Sequence
  chemically synthesized
SQVSPFKIPIEELEDRVFVNCNTSIYRASSLSNCRHTTSMEE

SEQ ID NO: 3932 - protein, 42 aa, Artificial Sequence
  chemically synthesized
SQVSPFKIPIEELEDRVFVNCNTSIYRASSLSNCRHTTSVDE

SEQ ID NO: 3933 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASSLSNCRHTTSVXE

SEQ ID NO: 3934 - protein, 42 aa, Artificial Sequence
  chemically synthesized
SQVSPFKIPIEELEDRVFVNCNTSIYRASSLSNCRHTTSVED

SEQ ID NO: 3935 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASSLSNCRHTTSVEX

SEQ ID NO: 3936 - protein, 42 aa, Artificial Sequence
  chemically synthesized
SQVSAFKIPIEELEDRVFVNCNTSIYRASSLSNCRHTTSVEE

SEQ ID NO: 3937 - protein, 42 aa, Artificial Sequence
  chemically synthesized
SQVSGFKIPIEELEDRVFVNCNTSIYRASSLSNCRHTTSVEE

SEQ ID NO: 3938 - protein, 42 aa, Artificial Sequence
  chemically synthesized
SQVSPFKIAIEELEDRVFVNCNTSIYRASSLSNCRHTTSVEE

SEQ ID NO: 3939 - protein, 42 aa, Artificial Sequence
  chemically synthesized
SQVSPFKIGIEELEDRVFVNCNTSIYRASSLSNCRHTTSVEE

SEQ ID NO: 3940 - protein, 42 aa, Artificial Sequence; identical to SEQ ID NO: 111
  chemically synthesized

SEQ ID NO: 3941 - protein, 42 aa, Artificial Sequence; identical to SEQ ID NO: 230
  chemically synthesized

SEQ ID NO: 3942 - protein, 42 aa, Artificial Sequence
  chemically synthesized
YQVSPFKIPIEELEDRVFVNCNTSIYRASSLSNCRHTSTVEE

SEQ ID NO: 3943 - protein, 42 aa, Artificial Sequence; identical to SEQ ID NO: 350
  chemically synthesized

SEQ ID NO: 3944 - protein, 42 aa, Artificial Sequence; identical to SEQ ID NO: 468
  chemically synthesized

SEQ ID NO: 3945 - protein, 42 aa, Artificial Sequence
  chemically synthesized
SQISPFKIPIEELEDRVFVNCNTSIYRASSLSNCRHTSTVEE

SEQ ID NO: 3946 - protein, 42 aa, Artificial Sequence
  chemically synthesized
SQPSPFKIPIEELEDRVFVNCNTSIYRASSLSNCRHTSTVEE

SEQ ID NO: 3947 - protein, 42 aa, Artificial Sequence
  chemically synthesized
SQFSPFKIPIEELEDRVFVNCNTSIYRASSLSNCRHTSTVEE

SEQ ID NO: 3948 - protein, 42 aa, Artificial Sequence; identical to SEQ ID NO: 587
  chemically synthesized

SEQ ID NO: 3949 - protein, 42 aa, Artificial Sequence
  chemically synthesized
SQVYPFKIPIEELEDRVFVNCNTSIYRASSLSNCRHTSTVEE

SEQ ID NO: 3950 - protein, 42 aa, Artificial Sequence
  chemically synthesized
SQVSPWKIPIEELEDRVFVNCNTSIYRASSLSNCRHTSTVEE

SEQ ID NO: 3951 - protein, 42 aa, Artificial Sequence
  chemically synthesized
SQVSPYKIPIEELEDRVFVNCNTSIYRASSLSNCRHTSTVEE

SEQ ID NO: 3952 - protein, 42 aa, Artificial Sequence
  chemically synthesized
SQVSPHKIPIEELEDRVFVNCNTSIYRASSLSNCRHTSTVEE

SEQ ID NO: 3953 - protein, 42 aa, Artificial Sequence
  chemically synthesized
SQVSPFRIPIEELEDRVFVNCNTSIYRASSLSNCRHTSTVEE

SEQ ID NO: 3954 - protein, 42 aa, Artificial Sequence
  chemically synthesized
SQVSPFHIPIEELEDRVFVNCNTSIYRASSLSNCRHTSTVEE

SEQ ID NO: 3955 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSLSNCRHTSTVEE

SEQ ID NO: 3956 - protein, 42 aa, Artificial Sequence; identical to SEQ ID NO: 826
  chemically synthesized

SEQ ID NO: 3957 - protein, 42 aa, Artificial Sequence
  chemically synthesized
SQVSPFKHPIEELEDRVFVNCNTSIYRASSLSNCRHTSTVEE

SEQ ID NO: 3958 - protein, 42 aa, Artificial Sequence
  chemically synthesized
SQVSPFKVPIEELEDRVFVNCNTSIYRASSLSNCRHTSTVEE

SEQ ID NO: 3959 - protein, 42 aa, Artificial Sequence
  chemically synthesized
SQVSPFKFPIEELEDRVFVNCNTSIYRASSLSNCRHTSTVEE

SEQ ID NO: 3960 - protein, 42 aa, Artificial Sequence
  chemically synthesized
SQVSPFKMPIEELEDRVFVNCNTSIYRASSLSNCRHTSTVEE

SEQ ID NO: 3961 - protein, 42 aa, Artificial Sequence; identical to SEQ ID NO: 944
  chemically synthesized

SEQ ID NO: 3962 - protein, 42 aa, Artificial Sequence
  chemically synthesized
SQVSPFKIPHEELEDRVFVNCNTSIYRASSLSNCRHTSTVEE

SEQ ID NO: 3963 - protein, 42 aa, Artificial Sequence
  chemically synthesized
SQVSPFKIPVEELEDRVFVNCNTSIYRASSLSNCRHTSTVEE

SEQ ID NO: 3964 - protein, 42 aa, Artificial Sequence
  chemically synthesized
SQVSPFKIPFEELEDRVFVNCNTSIYRASSLSNCRHTSTVEE

SEQ ID NO: 3965 - protein, 42 aa, Artificial Sequence
  chemically synthesized
SQVSPFKIPMEELEDRVFVNCNTSIYRASSLSNCRHTSTVEE

SEQ ID NO: 3966 - protein, 42 aa, Artificial Sequence; identical to SEQ ID NO: 1064
  chemically synthesized

SEQ ID NO: 3967 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSLSNCRHTSTVEE

SEQ ID NO: 3968 - protein, 42 aa, Artificial Sequence; identical to SEQ ID NO: 1184
  chemically synthesized

SEQ ID NO: 3969 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSLSNCRHTSTVEE

SEQ ID NO: 3970 - protein, 42 aa, Artificial Sequence
  chemically synthesized
SQVSPFKIPIEEVEDRVFVNCNTSIYRASSLSNCRHTSTVEE

SEQ ID NO: 3971 - protein, 42 aa, Artificial Sequence; identical to SEQ ID NO: 1301
  chemically synthesized

SEQ ID NO: 3972 - protein, 42 aa, Artificial Sequence
  chemically synthesized
SQVSPFKIPIEEFEDRVFVNCNTSIYRASSLSNCRHTSTVEE

SEQ ID NO: 3973 - protein, 42 aa, Artificial Sequence
  chemically synthesized
SQVSPFKIPIEEHEDRVFVNCNTSIYRASSLSNCRHTSTVEE

SEQ ID NO: 3974 - protein, 42 aa, Artificial Sequence
  chemically synthesized
SQVSPFKIPIEEMEDRVFVNCNTSIYRASSLSNCRHTSTVEE

SEQ ID NO: 3975 - protein, 42 aa, Artificial Sequence; identical to SEQ ID NO: 1421
  chemically synthesized

SEQ ID NO: 3976 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASSLSNCRHTSTVEE

SEQ ID NO: 3977 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSLSNCRHTSTVEE

SEQ ID NO: 3978 - protein, 42 aa, Artificial Sequence
  chemically synthesized
SQVSPFKIPIEELEERVFVNCNTSIYRASSLSNCRHTSTVEE

SEQ ID NO: 3979 - protein, 42 aa, Artificial Sequence; identical to SEQ ID NO: 1540
  chemically synthesized

SEQ ID NO: 3980 - protein, 42 aa, Artificial Sequence
  chemically synthesized
SQVSPFKIPIEELEDHVFVNCNTSIYRASSLSNCRHTSTVEE

SEQ ID NO: 3981 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSLSNCRHTSTVEE

SEQ ID NO: 3982 - protein, 42 aa, Artificial Sequence; identical to SEQ ID NO: 1657
  chemically synthesized

SEQ ID NO: 3983 - protein, 42 aa, Artificial Sequence
  chemically synthesized
SQVSPFKIPIEELEDRLFVNCNTSIYRASSLSNCRHTSTVEE

SEQ ID NO: 3984 - protein, 42 aa, Artificial Sequence
  chemically synthesized
SQVSPFKIPIEELEDRFFVNCNTSIYRASSLSNCRHTSTVEE

SEQ ID NO: 3985 - protein, 42 aa, Artificial Sequence
  chemically synthesized
SQVSPFKIPIEELEDRHFVNCNTSIYRASSLSNCRHTSTVEE

SEQ ID NO: 3986 - protein, 42 aa, Artificial Sequence
  chemically synthesized
SQVSPFKIPIEELEDRMFVNCNTSIYRASSLSNCRHTSTVEE

SEQ ID NO: 3987 - protein, 42 aa, Artificial Sequence; identical to SEQ ID NO: 1774
  chemically synthesized

SEQ ID NO: 3988 - protein, 42 aa, Artificial Sequence
  chemically synthesized
SQVSPFKIPIEELEDRVLVNCNTSIYRASSLSNCRHTSTVEE

SEQ ID NO: 3989 - protein, 42 aa, Artificial Sequence
  chemically synthesized
SQVSPFKIPIEELEDRVVVNCNTSIYRASSLSNCRHTSTVEE

SEQ ID NO: 3990 - protein, 42 aa, Artificial Sequence
  chemically synthesized
SQVSPFKIPIEELEDRVHVNCNTSIYRASSLSNCRHTSTVEE

SEQ ID NO: 3991 - protein, 42 aa, Artificial Sequence
  chemically synthesized
SQVSPFKIPIEELEDRVMVNCNTSIYRASSLSNCRHTSTVEE

SEQ ID NO: 3992 - protein, 42 aa, Artificial Sequence; identical to SEQ ID NO: 1891
  chemically synthesized

SEQ ID NO: 3993 - protein, 42 aa, Artificial Sequence
  chemically synthesized
SQVSPFKIPIEELEDRVFLNCNTSIYRASSLSNCRHTSTVEE

SEQ ID NO: 3994 - protein, 42 aa, Artificial Sequence
  chemically synthesized
SQVSPFKIPIEELEDRVFFNCNTSIYRASSLSNCRHTSTVEE

SEQ ID NO: 3995 - protein, 42 aa, Artificial Sequence
  chemically synthesized
SQVSPFKIPIEELEDRVFHNCNTSIYRASSLSNCRHTSTVEE

SEQ ID NO: 3996 - protein, 42 aa, Artificial Sequence
  chemically synthesized
SQVSPFKIPIEELEDRVFMNCNTSIYRASSLSNCRHTSTVEE

SEQ ID NO: 3997 - protein, 42 aa, Artificial Sequence; identical to SEQ ID NO: 2012
  chemically synthesized

SEQ ID NO: 3998 - protein, 42 aa, Artificial Sequence
  chemically synthesized
SQVSPFKIPIEELEDRVFVNSNTSIYRASSLSNCRHTSTVEE

SEQ ID NO: 3999 - protein, 42 aa, Artificial Sequence
  chemically synthesized
SQVSPFKIPIEELEDRVFVNGNTSIYRASSLSNCRHTSTVEE

SEQ ID NO: 4000 - protein, 42 aa, Artificial Sequence
  chemically synthesized
SQVSPFKIPIEELEDRVFVNANTSIYRASSLSNCRHTSTVEE

SEQ ID NO: 4001 - protein, 42 aa, Artificial Sequence; identical to SEQ ID NO: 2253
  chemically synthesized

SEQ ID NO: 4002 - protein, 42 aa, Artificial Sequence; identical to SEQ ID NO: 2373
  chemically synthesized

SEQ ID NO: 4003 - protein, 42 aa, Artificial Sequence
  chemically synthesized
SQVSPFKIPIEELEDRVFVNCNYSIYRASSLSNCRHTSTVEE

SEQ ID NO: 4004 - protein, 42 aa, Artificial Sequence; identical to SEQ ID NO: 2493
  chemically synthesized

SEQ ID NO: 4005 - protein, 42 aa, Artificial Sequence
  chemically synthesized
SQVSPFKIPIEELEDRVFVNCNTYIYRASSLSNCRHTSTVEE

SEQ ID NO: 4006 - protein, 42 aa, Artificial Sequence
  chemically synthesized
SQVSPFKIPIEELEDRVFVNCNTSVYRASSLSNCRHTSTVEE

SEQ ID NO: 4007 - protein, 42 aa, Artificial Sequence; identical to SEQ ID NO: 2610
  chemically synthesized

SEQ ID NO: 4008 - protein, 42 aa, Artificial Sequence
  chemically synthesized
SQVSPFKIPIEELEDRVFVNCNTSHYRASSLSNCRHTSTVEE

SEQ ID NO: 4009 - protein, 42 aa, Artificial Sequence
  chemically synthesized
SQVSPFKIPIEELEDRVFVNCNTSFYRASSLSNCRHTSTVEE

SEQ ID NO: 4010 - protein, 42 aa, Artificial Sequence
  chemically synthesized
SQVSPFKIPIEELEDRVFVNCNTSMYRASSLSNCRHTSTVEE

SEQ ID NO: 4011 - protein, 42 aa, Artificial Sequence
  chemically synthesized
SQVSPFKIPIEELEDRVFVNCNTSIWRASSLSNCRHTSTVEE

SEQ ID NO: 4012 - protein, 42 aa, Artificial Sequence
  chemically synthesized
SQVSPFKIPIEELEDRVFVNCNTSIFRASSLSNCRHTSTVEE

SEQ ID NO: 4013 - protein, 42 aa, Artificial Sequence
  chemically synthesized
SQVSPFKIPIEELEDRVFVNCNTSISRASSLSNCRHTSTVEE

SEQ ID NO: 4014 - protein, 42 aa, Artificial Sequence; identical to SEQ ID NO: 2728
  chemically synthesized

SEQ ID NO: 4015 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSLSNCRHTSTVEE

SEQ ID NO: 4016 - protein, 42 aa, Artificial Sequence
  chemically synthesized
SQVSPFKIPIEELEDRVFVNCNTSIYHASSLSNCRHTSTVEE

SEQ ID NO: 4017 - protein, 42 aa, Artificial Sequence; identical to SEQ ID NO: 2847
  chemically synthesized

SEQ ID NO: 4018 - protein, 42 aa, Artificial Sequence; identical to SEQ ID NO: 2968
  chemically synthesized

SEQ ID NO: 4019 - protein, 42 aa, Artificial Sequence; identical to SEQ ID NO: 3088
  chemically synthesized

SEQ ID NO: 4020 - protein, 42 aa, Artificial Sequence
  chemically synthesized
SQVSPFKIPIEELEDRVFVNCNTSIYRAYSLSNCRHTSTVEE

SEQ ID NO: 4021 - protein, 42 aa, Artificial Sequence; identical to SEQ ID NO: 3208
  chemically synthesized

SEQ ID NO: 4022 - protein, 42 aa, Artificial Sequence
  chemically synthesized
SQVSPFKIPIEELEDRVFVNCNTSIYRASYLSNCRHTSTVEE

SEQ ID NO: 4023 - protein, 42 aa, Artificial Sequence; identical to SEQ ID NO: 3325
  chemically synthesized

SEQ ID NO: 4024 - protein, 42 aa, Artificial Sequence
  chemically synthesized
SQVSPFKIPIEELEDRVFVNCNTSIYRASSVSNCRHTSTVEE

SEQ ID NO: 4025 - protein, 42 aa, Artificial Sequence
  chemically synthesized
SQVSPFKIPIEELEDRVFVNCNTSIYRASSFSNCRHTSTVEE

SEQ ID NO: 4026 - protein, 42 aa, Artificial Sequence
  chemically synthesized
SQVSPFKIPIEELEDRVFVNCNTSIYRASSMSNCRHTSTVEE

SEQ ID NO: 4027 - protein, 42 aa, Artificial Sequence
  chemically synthesized
SQVSPFKIPIEELEDRVFVNCNTSIYRASSHSNCRHTSTVEE

SEQ ID NO: 4028 - protein, 42 aa, Artificial Sequence; identical to SEQ ID NO: 3445
  chemically synthesized

SEQ ID NO: 4029 - protein, 42 aa, Artificial Sequence
  chemically synthesized
SQVSPFKIPIEELEDRVFVNCNTSIYRASSLYNCRHTSTVEE

SEQ ID NO: 4030 - protein, 42 aa, Artificial Sequence; identical to SEQ ID NO: 3566
  chemically synthesized

SEQ ID NO: 4031 - protein, 42 aa, Artificial Sequence
  chemically synthesized
SQVSPFKIPIEELEDRVFVNCNTSIYRASSLSNSRHTSTVEE

SEQ ID NO: 4032 - protein, 42 aa, Artificial Sequence
  chemically synthesized
SQVSPFKIPIEELEDRVFVNCNTSIYRASSLSNGRHTSTVEE

SEQ ID NO: 4033 - protein, 42 aa, Artificial Sequence
  chemically synthesized
SQVSPFKIPIEELEDRVFVNCNTSIYRASSLSNARHTSTVEE

SEQ ID NO: 4034 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRASSLSNCXHTSTVEE

SEQ ID NO: 4035 - protein, 42 aa, Artificial Sequence
  chemically synthesized
SQVSPFKIPIEELEDRVFVNCNTSIYRASSLSNCHHTSTVEE

SEQ ID NO: 4036 - protein, 42 aa, Artificial Sequence; identical to SEQ ID NO: 3685
  chemically synthesized

SEQ ID NO: 4037 - protein, 42 aa, Artificial Sequence
  chemically synthesized
SQVSPFKIPIEELEDRVFVNCNTSIYRASSLSNCRGTSTVEE

SEQ ID NO: 4038 - protein, 42 aa, Artificial Sequence
  chemically synthesized
SQVSPFKIPIEELEDRVFVNCNTSIYRASSLSNCRATSTVEE

SEQ ID NO: 4039 - protein, 42 aa, Artificial Sequence
  chemically synthesized
SQVSPFKIPIEELEDRVFVNCNTSIYRASSLSNCRITSTVEE

SEQ ID NO: 4040 - protein, 42 aa, Artificial Sequence
  chemically synthesized
SQVSPFKIPIEELEDRVFVNCNTSIYRASSLSNCRLTSTVEE

SEQ ID NO: 4041 - protein, 42 aa, Artificial Sequence
  chemically synthesized
SQVSPFKIPIEELEDRVFVNCNTSIYRASSLSNCRMTSTVEE

SEQ ID NO: 4042 - protein, 42 aa, Artificial Sequence
  chemically synthesized
SQVSPFKIPIEELEDRVFVNCNTSIYRASSLSNCRVTSTVEE

SEQ ID NO: 4043 - protein, 42 aa, Artificial Sequence; identical to SEQ ID NO: 3805
  chemically synthesized

SEQ ID NO: 4044 - protein, 42 aa, Artificial Sequence
  chemically synthesized
SQVSPFKIPIEELEDRVFVNCNTSIYRASSLSNCRHYSTVEE

SEQ ID NO: 4045 - protein, 42 aa, Artificial Sequence; identical to SEQ ID NO: 3925
  chemically synthesized

SEQ ID NO: 4046 - protein, 42 aa, Artificial Sequence
  chemically synthesized
SQVSPFKIPIEELEDRVFVNCNTSIYRASSLSNCRHTYTVEE

SEQ ID NO: 4047 - protein, 42 aa, Artificial Sequence
  chemically synthesized
SQVSPFKIPIEELEDRVFVNCNTSIYRASSLSNCRHTSTIEE

SEQ ID NO: 4048 - protein, 42 aa, Artificial Sequence
  chemically synthesized
SQVSPFKIPIEELEDRVFVNCNTSIYRASSLSNCRHTSTLEE

SEQ ID NO: 4049 - protein, 42 aa, Artificial Sequence
  chemically synthesized
SQVSPFKIPIEELEDRVFVNCNTSIYRASSLSNCRHTSTFEE

SEQ ID NO: 4050 - protein, 42 aa, Artificial Sequence
  chemically synthesized
SQVSPFKIPIEELEDRVFVNCNTSIYRASSLSNCRHTSTHEE

SEQ ID NO: 4051 - protein, 42 aa, Artificial Sequence
  chemically synthesized
SQVSPFKIPIEELEDRVFVNCNTSIYRASSLSNCRHTSTMEE

SEQ ID NO: 4052 - protein, 42 aa, Artificial Sequence
  chemically synthesized
SQVSPFKIPIEELEDRVFVNCNTSIYRASSLSNCRHTSTVDE

SEQ ID NO: 4053 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASSLSNCRHTSTVXE

SEQ ID NO: 4054 - protein, 42 aa, Artificial Sequence
  chemically synthesized
SQVSPFKIPIEELEDRVFVNCNTSIYRASSLSNCRHTSTVED

SEQ ID NO: 4055 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASSLSNCRHTSTVEX

SEQ ID NO: 4056 - protein, 42 aa, Artificial Sequence
  chemically synthesized
SQVSAFKIPIEELEDRVFVNCNTSIYRASSLSNCRHTSTVEE

SEQ ID NO: 4057 - protein, 42 aa, Artificial Sequence
  chemically synthesized
SQVSGFKIPIEELEDRVFVNCNTSIYRASSLSNCRHTSTVEE

SEQ ID NO: 4058 - protein, 42 aa, Artificial Sequence
  chemically synthesized
SQVSPFKIAIEELEDRVFVNCNTSIYRASSLSNCRHTSTVEE

SEQ ID NO: 4059 - protein, 42 aa, Artificial Sequence
  chemically synthesized
SQVSPFKIGIEELEDRVFVNCNTSIYRASSLSNCRHTSTVEE

SEQ ID NO: 4060 - protein, 42 aa, Artificial Sequence; identical to SEQ ID NO: 113
  chemically synthesized

SEQ ID NO: 4061 - protein, 42 aa, Artificial Sequence; identical to SEQ ID NO: 232
  chemically synthesized

SEQ ID NO: 4062 - protein, 42 aa, Artificial Sequence
  chemically synthesized
YQVSPFKIPIEELEDRVFVNCNTSIYRASSLSNCRHTSSIEE

SEQ ID NO: 4063 - protein, 42 aa, Artificial Sequence; identical to SEQ ID NO: 352
  chemically synthesized

SEQ ID NO: 4064 - protein, 42 aa, Artificial Sequence; identical to SEQ ID NO: 470
  chemically synthesized

SEQ ID NO: 4065 - protein, 42 aa, Artificial Sequence
  chemically synthesized
SQISPFKIPIEELEDRVFVNCNTSIYRASSLSNCRHTSSIEE

SEQ ID NO: 4066 - protein, 42 aa, Artificial Sequence
  chemically synthesized
SQPSPFKIPIEELEDRVFVNCNTSIYRASSLSNCRHTSSIEE

SEQ ID NO: 4067 - protein, 42 aa, Artificial Sequence
  chemically synthesized
SQFSPFKIPIEELEDRVFVNCNTSIYRASSLSNCRHTSSIEE

SEQ ID NO: 4068 - protein, 42 aa, Artificial Sequence; identical to SEQ ID NO: 589
  chemically synthesized

SEQ ID NO: 4069 - protein, 42 aa, Artificial Sequence
  chemically synthesized
SQVYPFKIPIEELEDRVFVNCNTSIYRASSLSNCRHTSSIEE

SEQ ID NO: 4070 - protein, 42 aa, Artificial Sequence
  chemically synthesized
SQVSPWKIPIEELEDRVFVNCNTSIYRASSLSNCRHTSSIEE

SEQ ID NO: 4071 - protein, 42 aa, Artificial Sequence
  chemically synthesized
SQVSPYKIPIEELEDRVFVNCNTSIYRASSLSNCRHTSSIEE

SEQ ID NO: 4072 - protein, 42 aa, Artificial Sequence
  chemically synthesized
SQVSPHKIPIEELEDRVFVNCNTSIYRASSLSNCRHTSSIEE

SEQ ID NO: 4073 - protein, 42 aa, Artificial Sequence
  chemically synthesized
SQVSPFRIPIEELEDRVFVNCNTSIYRASSLSNCRHTSSIEE

SEQ ID NO: 4074 - protein, 42 aa, Artificial Sequence
  chemically synthesized
SQVSPFHIPIEELEDRVFVNCNTSIYRASSLSNCRHTSSIEE

SEQ ID NO: 4075 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSLSNCRHTSSIEE

SEQ ID NO: 4076 - protein, 42 aa, Artificial Sequence; identical to SEQ ID NO: 828
  chemically synthesized

SEQ ID NO: 4077 - protein, 42 aa, Artificial Sequence
  chemically synthesized
SQVSPFKHPIEELEDRVFVNCNTSIYRASSLSNCRHTSSIEE

SEQ ID NO: 4078 - protein, 42 aa, Artificial Sequence
  chemically synthesized
SQVSPFKVPIEELEDRVFVNCNTSIYRASSLSNCRHTSSIEE

SEQ ID NO: 4079 - protein, 42 aa, Artificial Sequence
  chemically synthesized
SQVSPFKFPIEELEDRVFVNCNTSIYRASSLSNCRHTSSIEE

SEQ ID NO: 4080 - protein, 42 aa, Artificial Sequence
  chemically synthesized
SQVSPFKMPIEELEDRVFVNCNTSIYRASSLSNCRHTSSIEE

SEQ ID NO: 4081 - protein, 42 aa, Artificial Sequence; identical to SEQ ID NO: 946
  chemically synthesized

SEQ ID NO: 4082 - protein, 42 aa, Artificial Sequence
  chemically synthesized
SQVSPFKIPHEELEDRVFVNCNTSIYRASSLSNCRHTSSIEE

SEQ ID NO: 4083 - protein, 42 aa, Artificial Sequence
  chemically synthesized
SQVSPFKIPVEELEDRVFVNCNTSIYRASSLSNCRHTSSIEE

SEQ ID NO: 4084 - protein, 42 aa, Artificial Sequence
  chemically synthesized
SQVSPFKIPFEELEDRVFVNCNTSIYRASSLSNCRHTSSIEE

SEQ ID NO: 4085 - protein, 42 aa, Artificial Sequence
  chemically synthesized
SQVSPFKIPMEELEDRVFVNCNTSIYRASSLSNCRHTSSIEE

SEQ ID NO: 4086 - protein, 42 aa, Artificial Sequence
  chemically synthesized
SQVSPFKIPIDELEDRVFVNCNTSIYRASSLSNCRHTSSIEE

SEQ ID NO: 4087 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSLSNCRHTSSIEE

SEQ ID NO: 4088 - protein, 42 aa, Artificial Sequence; identical to SEQ ID NO: 1186
  chemically synthesized

SEQ ID NO: 4089 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSLSNCRHTSSIEE

SEQ ID NO: 4090 - protein, 42 aa, Artificial Sequence
  chemically synthesized
SQVSPFKIPIEEVEDRVFVNCNTSIYRASSLSNCRHTSSIEE

SEQ ID NO: 4091 - protein, 42 aa, Artificial Sequence; identical to SEQ ID NO: 1303
  chemically synthesized

SEQ ID NO: 4092 - protein, 42 aa, Artificial Sequence
  chemically synthesized
SQVSPFKIPIEEFEDRVFVNCNTSIYRASSLSNCRHTSSIEE

SEQ ID NO: 4093 - protein, 42 aa, Artificial Sequence
  chemically synthesized
SQVSPFKIPIEEHEDRVFVNCNTSIYRASSLSNCRHTSSIEE

SEQ ID NO: 4094 - protein, 42 aa, Artificial Sequence
  chemically synthesized
SQVSPFKIPIEEMEDRVFVNCNTSIYRASSLSNCRHTSSIEE

SEQ ID NO: 4095 - protein, 42 aa, Artificial Sequence; identical to SEQ ID NO: 1423
  chemically synthesized

SEQ ID NO: 4096 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASSLSNCRHTSSIEE

SEQ ID NO: 4097 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSLSNCRHTSSIEE

SEQ ID NO: 4098 - protein, 42 aa, Artificial Sequence
  chemically synthesized
SQVSPFKIPIEELEERVFVNCNTSIYRASSLSNCRHTSSIEE

SEQ ID NO: 4099 - protein, 42 aa, Artificial Sequence; identical to SEQ ID NO: 1542
  chemically synthesized

SEQ ID NO: 4100 - protein, 42 aa, Artificial Sequence
  chemically synthesized
SQVSPFKIPIEELEDHVFVNCNTSIYRASSLSNCRHTSSIEE

SEQ ID NO: 4101 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSLSNCRHTSSIEE

SEQ ID NO: 4102 - protein, 42 aa, Artificial Sequence; identical to SEQ ID NO: 1659
  chemically synthesized

SEQ ID NO: 4103 - protein, 42 aa, Artificial Sequence
  chemically synthesized
SQVSPFKIPIEELEDRLFVNCNTSIYRASSLSNCRHTSSIEE

SEQ ID NO: 4104 - protein, 42 aa, Artificial Sequence
  chemically synthesized
SQVSPFKIPIEELEDRFFVNCNTSIYRASSLSNCRHTSSIEE

SEQ ID NO: 4105 - protein, 42 aa, Artificial Sequence
  chemically synthesized
SQVSPFKIPIEELEDRHFVNCNTSIYRASSLSNCRHTSSIEE

SEQ ID NO: 4106 - protein, 42 aa, Artificial Sequence
  chemically synthesized
SQVSPFKIPIEELEDRMFVNCNTSIYRASSLSNCRHTSSIEE

SEQ ID NO: 4107 - protein, 42 aa, Artificial Sequence; identical to SEQ ID NO: 1776
  chemically synthesized

SEQ ID NO: 4108 - protein, 42 aa, Artificial Sequence
  chemically synthesized
SQVSPFKIPIEELEDRVLVNCNTSIYRASSLSNCRHTSSIEE

SEQ ID NO: 4109 - protein, 42 aa, Artificial Sequence
  chemically synthesized
SQVSPFKIPIEELEDRVVVNCNTSIYRASSLSNCRHTSSIEE

SEQ ID NO: 4110 - protein, 42 aa, Artificial Sequence
  chemically synthesized
SQVSPFKIPIEELEDRVHVNCNTSIYRASSLSNCRHTSSIEE

SEQ ID NO: 4111 - protein, 42 aa, Artificial Sequence
  chemically synthesized
SQVSPFKIPIEELEDRVMVNCNTSIYRASSLSNCRHTSSIEE

SEQ ID NO: 4112 - protein, 42 aa, Artificial Sequence; identical to SEQ ID NO: 1893
  chemically synthesized

SEQ ID NO: 4113 - protein, 42 aa, Artificial Sequence
  chemically synthesized
SQVSPFKIPIEELEDRVFLNCNTSIYRASSLSNCRHTSSIEE

SEQ ID NO: 4114 - protein, 42 aa, Artificial Sequence
  chemically synthesized
SQVSPFKIPIEELEDRVFFNCNTSIYRASSLSNCRHTSSIEE

SEQ ID NO: 4115 - protein, 42 aa, Artificial Sequence
  chemically synthesized
SQVSPFKIPIEELEDRVFHNCNTSIYRASSLSNCRHTSSIEE

SEQ ID NO: 4116 - protein, 42 aa, Artificial Sequence
  chemically synthesized
SQVSPFKIPIEELEDRVFMNCNTSIYRASSLSNCRHTSSIEE

SEQ ID NO: 4117 - protein, 42 aa, Artificial Sequence; identical to SEQ ID NO: 2014
  chemically synthesized

SEQ ID NO: 4118 - protein, 42 aa, Artificial Sequence
  chemically synthesized
SQVSPFKIPIEELEDRVFVNSNTSIYRASSLSNCRHTSSIEE

SEQ ID NO: 4119 - protein, 42 aa, Artificial Sequence
  chemically synthesized
SQVSPFKIPIEELEDRVFVNGNTSIYRASSLSNCRHTSSIEE

SEQ ID NO: 4120 - protein, 42 aa, Artificial Sequence
  chemically synthesized
SQVSPFKIPIEELEDRVFVNANTSIYRASSLSNCRHTSSIEE

SEQ ID NO: 4121 - protein, 42 aa, Artificial Sequence; identical to SEQ ID NO: 2255
  chemically synthesized

SEQ ID NO: 4122 - protein, 42 aa, Artificial Sequence; identical to SEQ ID NO: 2375
  chemically synthesized

SEQ ID NO: 4123 - protein, 42 aa, Artificial Sequence
  chemically synthesized
SQVSPFKIPIEELEDRVFVNCNYSIYRASSLSNCRHTSSIEE

SEQ ID NO: 4124 - protein, 42 aa, Artificial Sequence; identical to SEQ ID NO: 2495
  chemically synthesized

SEQ ID NO: 4125 - protein, 42 aa, Artificial Sequence
  chemically synthesized
SQVSPFKIPIEELEDRVFVNCNTYIYRASSLSNCRHTSSIEE

SEQ ID NO: 4126 - protein, 42 aa, Artificial Sequence
  chemically synthesized
SQVSPFKIPIEELEDRVFVNCNTSVYRASSLSNCRHTSSIEE

SEQ ID NO: 4127 - protein, 42 aa, Artificial Sequence; identical to SEQ ID NO: 2612
  chemically synthesized

SEQ ID NO: 4128 - protein, 42 aa, Artificial Sequence
  chemically synthesized
SQVSPFKIPIEELEDRVFVNCNTSHYRASSLSNCRHTSSIEE

SEQ ID NO: 4129 - protein, 42 aa, Artificial Sequence
  chemically synthesized
SQVSPFKIPIEELEDRVFVNCNTSFYRASSLSNCRHTSSIEE

SEQ ID NO: 4130 - protein, 42 aa, Artificial Sequence
  chemically synthesized
SQVSPFKIPIEELEDRVFVNCNTSMYRASSLSNCRHTSSIEE

SEQ ID NO: 4131 - protein, 42 aa, Artificial Sequence
  chemically synthesized
SQVSPFKIPIEELEDRVFVNCNTSIWRASSLSNCRHTSSIEE

SEQ ID NO: 4132 - protein, 42 aa, Artificial Sequence
  chemically synthesized
SQVSPFKIPIEELEDRVFVNCNTSIFRASSLSNCRHTSSIEE

SEQ ID NO: 4133 - protein, 42 aa, Artificial Sequence
  chemically synthesized
SQVSPFKIPIEELEDRVFVNCNTSISRASSLSNCRHTSSIEE

SEQ ID NO: 4134 - protein, 42 aa, Artificial Sequence; identical to SEQ ID NO: 2730
  chemically synthesized

SEQ ID NO: 4135 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSLSNCRHTSSIEE

SEQ ID NO: 4136 - protein, 42 aa, Artificial Sequence
  chemically synthesized
SQVSPFKIPIEELEDRVFVNCNTSIYHASSLSNCRHTSSIEE

SEQ ID NO: 4137 - protein, 42 aa, Artificial Sequence; identical to SEQ ID NO: 2849
  chemically synthesized

SEQ ID NO: 4138 - protein, 42 aa, Artificial Sequence; identical to SEQ ID NO: 2970
  chemically synthesized

SEQ ID NO: 4139 - protein, 42 aa, Artificial Sequence; identical to SEQ ID NO: 3090
  chemically synthesized

SEQ ID NO: 4140 - protein, 42 aa, Artificial Sequence
  chemically synthesized
SQVSPFKIPIEELEDRVFVNCNTSIYRAYSLSNCRHTSSIEE

SEQ ID NO: 4141 - protein, 42 aa, Artificial Sequence; identical to SEQ ID NO: 3210
  chemically synthesized

SEQ ID NO: 4142 - protein, 42 aa, Artificial Sequence
  chemically synthesized
SQVSPFKIPIEELEDRVFVNCNTSIYRASYLSNCRHTSSIEE

SEQ ID NO: 4143 - protein, 42 aa, Artificial Sequence; identical to SEQ ID NO: 3327
  chemically synthesized

SEQ ID NO: 4144 - protein, 42 aa, Artificial Sequence
  chemically synthesized
SQVSPFKIPIEELEDRVFVNCNTSIYRASSVSNCRHTSSIEE

SEQ ID NO: 4145 - protein, 42 aa, Artificial Sequence
  chemically synthesized
SQVSPFKIPIEELEDRVFVNCNTSIYRASSFSNCRHTSSIEE

SEQ ID NO: 4146 - protein, 42 aa, Artificial Sequence
  chemically synthesized
SQVSPFKIPIEELEDRVFVNCNTSIYRASSMSNCRHTSSIEE

SEQ ID NO: 4147 - protein, 42 aa, Artificial Sequence
  chemically synthesized
SQVSPFKIPIEELEDRVFVNCNTSIYRASSHSNCRHTSSIEE

SEQ ID NO: 4148 - protein, 42 aa, Artificial Sequence; identical to SEQ ID NO: 3447
  chemically synthesized

SEQ ID NO: 4149 - protein, 42 aa, Artificial Sequence
  chemically synthesized
SQVSPFKIPIEELEDRVFVNCNTSIYRASSLYNCRHTSSIEE

SEQ ID NO: 4150 - protein, 42 aa, Artificial Sequence; identical to SEQ ID NO: 3568
  chemically synthesized

SEQ ID NO: 4151 - protein, 42 aa, Artificial Sequence
  chemically synthesized
SQVSPFKIPIEELEDRVFVNCNTSIYRASSLSNSRHTSSIEE

SEQ ID NO: 4152 - protein, 42 aa, Artificial Sequence
  chemically synthesized
SQVSPFKIPIEELEDRVFVNCNTSIYRASSLSNGRHTSSIEE

SEQ ID NO: 4153 - protein, 42 aa, Artificial Sequence
  chemically synthesized
SQVSPFKIPIEELEDRVFVNCNTSIYRASSLSNARHTSSIEE

SEQ ID NO: 4154 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRASSLSNCXHTSSIEE

SEQ ID NO: 4155 - protein, 42 aa, Artificial Sequence
  chemically synthesized
SQVSPFKIPIEELEDRVFVNCNTSIYRASSLSNCHHTSSIEE

SEQ ID NO: 4156 - protein, 42 aa, Artificial Sequence; identical to SEQ ID NO: 3687
  chemically synthesized

SEQ ID NO: 4157 - protein, 42 aa, Artificial Sequence
  chemically synthesized
SQVSPFKIPIEELEDRVFVNCNTSIYRASSLSNCRGTSSIEE

SEQ ID NO: 4158 - protein, 42 aa, Artificial Sequence
  chemically synthesized
SQVSPFKIPIEELEDRVFVNCNTSIYRASSLSNCRATSSIEE

SEQ ID NO: 4159 - protein, 42 aa, Artificial Sequence
  chemically synthesized
SQVSPFKIPIEELEDRVFVNCNTSIYRASSLSNCRITSSIEE

SEQ ID NO: 4160 - protein, 42 aa, Artificial Sequence
  chemically synthesized
SQVSPFKIPIEELEDRVFVNCNTSIYRASSLSNCRLTSSIEE

SEQ ID NO: 4161 - protein, 42 aa, Artificial Sequence
  chemically synthesized
SQVSPFKIPIEELEDRVFVNCNTSIYRASSLSNCRMTSSIEE

SEQ ID NO: 4162 - protein, 42 aa, Artificial Sequence
  chemically synthesized
SQVSPFKIPIEELEDRVFVNCNTSIYRASSLSNCRVTSSIEE

SEQ ID NO: 4163 - protein, 42 aa, Artificial Sequence; identical to SEQ ID NO: 3807
  chemically synthesized

SEQ ID NO: 4164 - protein, 42 aa, Artificial Sequence
  chemically synthesized
SQVSPFKIPIEELEDRVFVNCNTSIYRASSLSNCRHYSSIEE

SEQ ID NO: 4165 - protein, 42 aa, Artificial Sequence; identical to SEQ ID NO: 3927
  chemically synthesized

SEQ ID NO: 4166 - protein, 42 aa, Artificial Sequence
  chemically synthesized
SQVSPFKIPIEELEDRVFVNCNTSIYRASSLSNCRHTYSIEE

SEQ ID NO: 4167 - protein, 42 aa, Artificial Sequence; identical to SEQ ID NO: 4047
  chemically synthesized

SEQ ID NO: 4168 - protein, 42 aa, Artificial Sequence
  chemically synthesized
SQVSPFKIPIEELEDRVFVNCNTSIYRASSLSNCRHTSYIEE

SEQ ID NO: 4169 - protein, 42 aa, Artificial Sequence
  chemically synthesized
SQVSPFKIPIEELEDRVFVNCNTSIYRASSLSNCRHTSSIDE

SEQ ID NO: 4170 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASSLSNCRHTSSIXE

SEQ ID NO: 4171 - protein, 42 aa, Artificial Sequence
  chemically synthesized
SQVSPFKIPIEELEDRVFVNCNTSIYRASSLSNCRHTSSIED

SEQ ID NO: 4172 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASSLSNCRHTSSIEX

SEQ ID NO: 4173 - protein, 42 aa, Artificial Sequence
  chemically synthesized
SQVSAFKIPIEELEDRVFVNCNTSIYRASSLSNCRHTSSIEE

SEQ ID NO: 4174 - protein, 42 aa, Artificial Sequence
  chemically synthesized
SQVSGFKIPIEELEDRVFVNCNTSIYRASSLSNCRHTSSIEE

SEQ ID NO: 4175 - protein, 42 aa, Artificial Sequence
  chemically synthesized
SQVSPFKIAIEELEDRVFVNCNTSIYRASSLSNCRHTSSIEE

SEQ ID NO: 4176 - protein, 42 aa, Artificial Sequence
  chemically synthesized
SQVSPFKIGIEELEDRVFVNCNTSIYRASSLSNCRHTSSIEE

SEQ ID NO: 4177 - protein, 42 aa, Artificial Sequence; identical to SEQ ID NO: 118
  chemically synthesized

SEQ ID NO: 4178 - protein, 42 aa, Artificial Sequence; identical to SEQ ID NO: 237
  chemically synthesized

SEQ ID NO: 4179 - protein, 42 aa, Artificial Sequence
  chemically synthesized
YQVSPFKIPIEELEDRVFVNCNTSIYRASSLSNCRHTSSVDE

SEQ ID NO: 4180 - protein, 42 aa, Artificial Sequence; identical to SEQ ID NO: 357
  chemically synthesized

SEQ ID NO: 4181 - protein, 42 aa, Artificial Sequence; identical to SEQ ID NO: 475
  chemically synthesized

SEQ ID NO: 4182 - protein, 42 aa, Artificial Sequence
  chemically synthesized
SQISPFKIPIEELEDRVFVNCNTSIYRASSLSNCRHTSSVDE

SEQ ID NO: 4183 - protein, 42 aa, Artificial Sequence
  chemically synthesized
SQPSPFKIPIEELEDRVFVNCNTSIYRASSLSNCRHTSSVDE

SEQ ID NO: 4184 - protein, 42 aa, Artificial Sequence
  chemically synthesized
SQFSPFKIPIEELEDRVFVNCNTSIYRASSLSNCRHTSSVDE

SEQ ID NO: 4185 - protein, 42 aa, Artificial Sequence; identical to SEQ ID NO: 594
  chemically synthesized

SEQ ID NO: 4186 - protein, 42 aa, Artificial Sequence
  chemically synthesized
SQVYPFKIPIEELEDRVFVNCNTSIYRASSLSNCRHTSSVDE

SEQ ID NO: 4187 - protein, 42 aa, Artificial Sequence
  chemically synthesized
SQVSPWKIPIEELEDRVFVNCNTSIYRASSLSNCRHTSSVDE

SEQ ID NO: 4188 - protein, 42 aa, Artificial Sequence
  chemically synthesized
SQVSPYKIPIEELEDRVFVNCNTSIYRASSLSNCRHTSSVDE

SEQ ID NO: 4189 - protein, 42 aa, Artificial Sequence
  chemically synthesized
SQVSPHKIPIEELEDRVFVNCNTSIYRASSLSNCRHTSSVDE

SEQ ID NO: 4190 - protein, 42 aa, Artificial Sequence
  chemically synthesized
SQVSPFRIPIEELEDRVFVNCNTSIYRASSLSNCRHTSSVDE

SEQ ID NO: 4191 - protein, 42 aa, Artificial Sequence
  chemically synthesized
SQVSPFHIPIEELEDRVFVNCNTSIYRASSLSNCRHTSSVDE

SEQ ID NO: 4192 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSLSNCRHTSSVDE

SEQ ID NO: 4193 - protein, 42 aa, Artificial Sequence; identical to SEQ ID NO: 833
  chemically synthesized

SEQ ID NO: 4194 - protein, 42 aa, Artificial Sequence
  chemically synthesized
SQVSPFKHPIEELEDRVFVNCNTSIYRASSLSNCRHTSSVDE

SEQ ID NO: 4195 - protein, 42 aa, Artificial Sequence
  chemically synthesized
SQVSPFKVPIEELEDRVFVNCNTSIYRASSLSNCRHTSSVDE

SEQ ID NO: 4196 - protein, 42 aa, Artificial Sequence
  chemically synthesized
SQVSPFKFPIEELEDRVFVNCNTSIYRASSLSNCRHTSSVDE

SEQ ID NO: 4197 - protein, 42 aa, Artificial Sequence
  chemically synthesized
SQVSPFKMPIEELEDRVFVNCNTSIYRASSLSNCRHTSSVDE

SEQ ID NO: 4198 - protein, 42 aa, Artificial Sequence; identical to SEQ ID NO: 951
  chemically synthesized

SEQ ID NO: 4199 - protein, 42 aa, Artificial Sequence
  chemically synthesized
SQVSPFKIPHEELEDRVFVNCNTSIYRASSLSNCRHTSSVDE

SEQ ID NO: 4200 - protein, 42 aa, Artificial Sequence
  chemically synthesized
SQVSPFKIPVEELEDRVFVNCNTSIYRASSLSNCRHTSSVDE

SEQ ID NO: 4201 - protein, 42 aa, Artificial Sequence
  chemically synthesized
SQVSPFKIPFEELEDRVFVNCNTSIYRASSLSNCRHTSSVDE

SEQ ID NO: 4202 - protein, 42 aa, Artificial Sequence
  chemically synthesized
SQVSPFKIPMEELEDRVFVNCNTSIYRASSLSNCRHTSSVDE

SEQ ID NO: 4203 - protein, 42 aa, Artificial Sequence
  chemically synthesized
SQVSPFKIPIDELEDRVFVNCNTSIYRASSLSNCRHTSSVDE

SEQ ID NO: 4204 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSLSNCRHTSSVDE

SEQ ID NO: 4205 - protein, 42 aa, Artificial Sequence; identical to SEQ ID NO: 1191
  chemically synthesized

SEQ ID NO: 4206 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSLSNCRHTSSVDE

SEQ ID NO: 4207 - protein, 42 aa, Artificial Sequence
  chemically synthesized
SQVSPFKIPIEEVEDRVFVNCNTSIYRASSLSNCRHTSSVDE

SEQ ID NO: 4208 - protein, 42 aa, Artificial Sequence; identical to SEQ ID NO: 1308
  chemically synthesized

SEQ ID NO: 4209 - protein, 42 aa, Artificial Sequence
  chemically synthesized
SQVSPFKIPIEEFEDRVFVNCNTSIYRASSLSNCRHTSSVDE

SEQ ID NO: 4210 - protein, 42 aa, Artificial Sequence
  chemically synthesized
SQVSPFKIPIEEHEDRVFVNCNTSIYRASSLSNCRHTSSVDE

SEQ ID NO: 4211 - protein, 42 aa, Artificial Sequence
  chemically synthesized
SQVSPFKIPIEEMEDRVFVNCNTSIYRASSLSNCRHTSSVDE

SEQ ID NO: 4212 - protein, 42 aa, Artificial Sequence; identical to SEQ ID NO: 1428
  chemically synthesized

SEQ ID NO: 4213 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASSLSNCRHTSSVDE

SEQ ID NO: 4214 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSLSNCRHTSSVDE

SEQ ID NO: 4215 - protein, 42 aa, Artificial Sequence
  chemically synthesized
SQVSPFKIPIEELDERVFVNCNTSIYRASSLSNCRHTSSVDE

SEQ ID NO: 4216 - protein, 42 aa, Artificial Sequence; identical to SEQ ID NO: 1547
  chemically synthesized

SEQ ID NO: 4217 - protein, 42 aa, Artificial Sequence
  chemically synthesized
SQVSPFKIPIEELEDHVFVNCNTSIYRASSLSNCRHTSSVDE

SEQ ID NO: 4218 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSLSNCRHTSSVDE

SEQ ID NO: 4219 - protein, 42 aa, Artificial Sequence; identical to SEQ ID NO: 1664
  chemically synthesized

SEQ ID NO: 4220 - protein, 42 aa, Artificial Sequence
  chemically synthesized
SQVSPFKIPIEELEDRLFVNCNTSIYRASSLSNCRHTSSVDE

SEQ ID NO: 4221 - protein, 42 aa, Artificial Sequence
  chemically synthesized
SQVSPFKIPIEELEDRFFVNCNTSIYRASSLSNCRHTSSVDE

SEQ ID NO: 4222 - protein, 42 aa, Artificial Sequence
  chemically synthesized
SQVSPFKIPIEELEDRHFVNCNTSIYRASSLSNCRHTSSVDE

SEQ ID NO: 4223 - protein, 42 aa, Artificial Sequence
  chemically synthesized
SQVSPFKIPIEELEDRMFVNCNTSIYRASSLSNCRHTSSVDE

SEQ ID NO: 4224 - protein, 42 aa, Artificial Sequence; identical to SEQ ID NO: 1781
  chemically synthesized

SEQ ID NO: 4225 - protein, 42 aa, Artificial Sequence
  chemically synthesized
SQVSPFKIPIEELEDRVLVNCNTSIYRASSLSNCRHTSSVDE

SEQ ID NO: 4226 - protein, 42 aa, Artificial Sequence
  chemically synthesized
SQVSPFKIPIEELEDRVVVNCNTSIYRASSLSNCRHTSSVDE

SEQ ID NO: 4227 - protein, 42 aa, Artificial Sequence
  chemically synthesized
SQVSPFKIPIEELEDRVHVNCNTSIYRASSLSNCRHTSSVDE

SEQ ID NO: 4228 - protein, 42 aa, Artificial Sequence
  chemically synthesized
SQVSPFKIPIEELEDRVMVNCNTSIYRASSLSNCRHTSSVDE

SEQ ID NO: 4229 - protein, 42 aa, Artificial Sequence; identical to SEQ ID NO: 1898
  chemically synthesized

SEQ ID NO: 4230 - protein, 42 aa, Artificial Sequence
  chemically synthesized
SQVSPFKIPIEELEDRVFLNCNTSIYRASSLSNCRHTSSVDE

SEQ ID NO: 4231 - protein, 42 aa, Artificial Sequence
  chemically synthesized
SQVSPFKIPIEELEDRVFFNCNTSIYRASSLSNCRHTSSVDE

SEQ ID NO: 4232 - protein, 42 aa, Artificial Sequence
  chemically synthesized
SQVSPFKIPIEELEDRVFHNCNTSIYRASSLSNCRHTSSVDE

SEQ ID NO: 4233 - protein, 42 aa, Artificial Sequence
  chemically synthesized
SQVSPFKIPIEELEDRVFMNCNTSIYRASSLSNCRHTSSVDE

SEQ ID NO: 4234 - protein, 42 aa, Artificial Sequence; identical to SEQ ID NO: 2019
  chemically synthesized

SEQ ID NO: 4235 - protein, 42 aa, Artificial Sequence
  chemically synthesized
SQVSPFKIPIEELEDRVFVNSNTSIYRASSLSNCRHTSSVDE

SEQ ID NO: 4236 - protein, 42 aa, Artificial Sequence
  chemically synthesized
SQVSPFKIPIEELEDRVFVNGNTSIYRASSLSNCRHTSSVDE

SEQ ID NO: 4237 - protein, 42 aa, Artificial Sequence
  chemically synthesized
SQVSPFKIPIEELEDRVFVNANTSIYRASSLSNCRHTSSVDE

SEQ ID NO: 4238 - protein, 42 aa, Artificial Sequence; identical to SEQ ID NO: 2260
  chemically synthesized

SEQ ID NO: 4239 - protein, 42 aa, Artificial Sequence; identical to SEQ ID NO: 2380
  chemically synthesized

SEQ ID NO: 4240 - protein, 42 aa, Artificial Sequence
  chemically synthesized
SQVSPFKIPIEELEDRVFVNCNYSIYRASSLSNCRHTSSVDE

SEQ ID NO: 4241 - protein, 42 aa, Artificial Sequence; identical to SEQ ID NO: 2500
  chemically synthesized

SEQ ID NO: 4242 - protein, 42 aa, Artificial Sequence
  chemically synthesized
SQVSPFKIPIEELEDRVFVNCNTYIYRASSLSNCRHTSSVDE

SEQ ID NO: 4243 - protein, 42 aa, Artificial Sequence
  chemically synthesized
SQVSPFKIPIEELEDRVFVNCNTSVYRASSLSNCRHTSSVDE

SEQ ID NO: 4244 - protein, 42 aa, Artificial Sequence; identical to SEQ ID NO: 2617
  chemically synthesized

SEQ ID NO: 4245 - protein, 42 aa, Artificial Sequence
  chemically synthesized
SQVSPFKIPIEELEDRVFVNCNTSHYRASSLSNCRHTSSVDE

SEQ ID NO: 4246 - protein, 42 aa, Artificial Sequence
  chemically synthesized
SQVSPFKIPIEELEDRVFVNCNTSFYRASSLSNCRHTSSVDE

SEQ ID NO: 4247 - protein, 42 aa, Artificial Sequence
  chemically synthesized
SQVSPFKIPIEELEDRVFVNCNTSMYRASSLSNCRHTSSVDE

SEQ ID NO: 4248 - protein, 42 aa, Artificial Sequence
  chemically synthesized
SQVSPFKIPIEELEDRVFVNCNTSIWRASSLSNCRHTSSVDE

SEQ ID NO: 4249 - protein, 42 aa, Artificial Sequence
  chemically synthesized
SQVSPFKIPIEELEDRVFVNCNTSIFRASSLSNCRHTSSVDE

SEQ ID NO: 4250 - protein, 42 aa, Artificial Sequence
  chemically synthesized
SQVSPFKIPIEELEDRVFVNCNTSISRASSLSNCRHTSSVDE

SEQ ID NO: 4251 - protein, 42 aa, Artificial Sequence; identical to SEQ ID NO: 2735
  chemically synthesized

SEQ ID NO: 4252 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSLSNCRHTSSVDE

SEQ ID NO: 4253 - protein, 42 aa, Artificial Sequence
  chemically synthesized
SQVSPFKIPIEELEDRVFVNCNTSIYHASSLSNCRHTSSVDE

SEQ ID NO: 4254 - protein, 42 aa, Artificial Sequence; identical to SEQ ID NO: 2854
  chemically synthesized

SEQ ID NO: 4255 - protein, 42 aa, Artificial Sequence; identical to SEQ ID NO: 2975
  chemically synthesized

SEQ ID NO: 4256 - protein, 42 aa, Artificial Sequence; identical to SEQ ID NO: 3095
  chemically synthesized

SEQ ID NO: 4257 - protein, 42 aa, Artificial Sequence
  chemically synthesized
SQVSPFKIPIEELEDRVFVNCNTSIYRAYSLSNCRHTSSVDE

SEQ ID NO: 4258 - protein, 42 aa, Artificial Sequence; identical to SEQ ID NO: 3215
  chemically synthesized

SEQ ID NO: 4259 - protein, 42 aa, Artificial Sequence
  chemically synthesized
SQVSPFKIPIEELEDRVFVNCNTSIYRASYLSNCRHTSSVDE

SEQ ID NO: 4260 - protein, 42 aa, Artificial Sequence; identical to SEQ ID NO: 3332
  chemically synthesized

SEQ ID NO: 4261 - protein, 42 aa, Artificial Sequence
  chemically synthesized
SQVSPFKIPIEELEDRVFVNCNTSIYRASSVSNCRHTSSVDE

SEQ ID NO: 4262 - protein, 42 aa, Artificial Sequence
  chemically synthesized
SQVSPFKIPIEELEDRVFVNCNTSIYRASSFSNCRHTSSVDE

SEQ ID NO: 4263 - protein, 42 aa, Artificial Sequence
  chemically synthesized
SQVSPFKIPIEELEDRVFVNCNTSIYRASSMSNCRHTSSVDE

SEQ ID NO: 4264 - protein, 42 aa, Artificial Sequence
  chemically synthesized
SQVSPFKIPIEELEDRVFVNCNTSIYRASSHSNCRHTSSVDE

SEQ ID NO: 4265 - protein, 42 aa, Artificial Sequence; identical to SEQ ID NO: 3452
  chemically synthesized

SEQ ID NO: 4266 - protein, 42 aa, Artificial Sequence
  chemically synthesized
SQVSPFKIPIEELEDRVFVNCNTSIYRASSLYNCRHTSSVDE

SEQ ID NO: 4267 - protein, 42 aa, Artificial Sequence; identical to SEQ ID NO: 3573
  chemically synthesized

SEQ ID NO: 4268 - protein, 42 aa, Artificial Sequence
  chemically synthesized
SQVSPFKIPIEELEDRVFVNCNTSIYRASSLSNSRHTSSVDE

SEQ ID NO: 4269 - protein, 42 aa, Artificial Sequence
  chemically synthesized
SQVSPFKIPIEELEDRVFVNCNTSIYRASSLSNGRHTSSVDE

SEQ ID NO: 4270 - protein, 42 aa, Artificial Sequence
  chemically synthesized
SQVSPFKIPIEELEDRVFVNCNTSIYRASSLSNARHTSSVDE

SEQ ID NO: 4271 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRASSLSNCXHTSSVDE

SEQ ID NO: 4272 - protein, 42 aa, Artificial Sequence
  chemically synthesized
SQVSPFKIPIEELEDRVFVNCNTSIYRASSLSNCHHTSSVDE

SEQ ID NO: 4273 - protein, 42 aa, Artificial Sequence; identical to SEQ ID NO: 3692
  chemically synthesized

SEQ ID NO: 4274 - protein, 42 aa, Artificial Sequence
  chemically synthesized
SQVSPFKIPIEELEDRVFVNCNTSIYRASSLSNCRGTSSVDE

SEQ ID NO: 4275 - protein, 42 aa, Artificial Sequence
  chemically synthesized
SQVSPFKIPIEELEDRVFVNCNTSIYRASSLSNCRATSSVDE

SEQ ID NO: 4276 - protein, 42 aa, Artificial Sequence
  chemically synthesized
SQVSPFKIPIEELEDRVFVNCNTSIYRASSLSNCRITSSVDE

SEQ ID NO: 4277 - protein, 42 aa, Artificial Sequence
  chemically synthesized
SQVSPFKIPIEELEDRVFVNCNTSIYRASSLSNCRLTSSVDE

SEQ ID NO: 4278 - protein, 42 aa, Artificial Sequence
  chemically synthesized
SQVSPFKIPIEELEDRVFVNCNTSIYRASSLSNCRMTSSVDE

SEQ ID NO: 4279 - protein, 42 aa, Artificial Sequence
  chemically synthesized
SQVSPFKIPIEELEDRVFVNCNTSIYRASSLSNCRVTSSVDE

SEQ ID NO: 4280 - protein, 42 aa, Artificial Sequence; identical to SEQ ID NO: 3812
  chemically synthesized

SEQ ID NO: 4281 - protein, 42 aa, Artificial Sequence
  chemically synthesized
SQVSPFKIPIEELEDRVFVNCNTSIYRASSLSNCRHYSSVDE

SEQ ID NO: 4282 - protein, 42 aa, Artificial Sequence; identical to SEQ ID NO: 3932
  chemically synthesized

SEQ ID NO: 4283 - protein, 42 aa, Artificial Sequence
  chemically synthesized
SQVSPFKIPIEELEDRVFVNCNTSIYRASSLSNCRHTYSVDE

SEQ ID NO: 4284 - protein, 42 aa, Artificial Sequence; identical to SEQ ID NO: 4052
  chemically synthesized

SEQ ID NO: 4285 - protein, 42 aa, Artificial Sequence
  chemically synthesized
SQVSPFKIPIEELEDRVFVNCNTSIYRASSLSNCRHTSYVDE

SEQ ID NO: 4286 - protein, 42 aa, Artificial Sequence; identical to SEQ ID NO: 4169
  chemically synthesized

SEQ ID NO: 4287 - protein, 42 aa, Artificial Sequence
  chemically synthesized
SQVSPFKIPIEELEDRVFVNCNTSIYRASSLSNCRHTSSLDE

SEQ ID NO: 4288 - protein, 42 aa, Artificial Sequence
  chemically synthesized
SQVSPFKIPIEELEDRVFVNCNTSIYRASSLSNCRHTSSFDE

SEQ ID NO: 4289 - protein, 42 aa, Artificial Sequence
  chemically synthesized
SQVSPFKIPIEELEDRVFVNCNTSIYRASSLSNCRHTSSHDE

SEQ ID NO: 4290 - protein, 42 aa, Artificial Sequence
  chemically synthesized
SQVSPFKIPIEELEDRVFVNCNTSIYRASSLSNCRHTSSMDE

SEQ ID NO: 4291 - protein, 42 aa, Artificial Sequence
  chemically synthesized
SQVSPFKIPIEELEDRVFVNCNTSIYRASSLSNCRHTSSVDD

SEQ ID NO: 4292 - protein, 42 aa, Artificial Sequence
  chemically synthesized
  misc_feature (42)..(42): Xaa can be a proteinogenic, non-proteinogenic or synthetic amino acid like ornithin or selenocystein
SQVSPFKIPIEELEDRVFVNCNTSIYRASSLSNCRHTSSVDX

SEQ ID NO: 4293 - protein, 42 aa, Artificial Sequence
  chemically synthesized
SQVSAFKIPIEELEDRVFVNCNTSIYRASSLSNCRHTSSVDE

SEQ ID NO: 4294 - protein, 42 aa, Artificial Sequence
  chemically synthesized
SQVSGFKIPIEELEDRVFVNCNTSIYRASSLSNCRHTSSVDE

SEQ ID NO: 4295 - protein, 42 aa, Artificial Sequence
  chemically synthesized
SQVSPFKIAIEELEDRVFVNCNTSIYRASSLSNCRHTSSVDE

SEQ ID NO: 4296 - protein, 42 aa, Artificial Sequence
  chemically synthesized
SQVSPFKIGIEELEDRVFVNCNTSIYRASSLSNCRHTSSVDE

SEQ ID NO: 4297 - protein, 42 aa, Artificial Sequence; identical to SEQ ID NO: 120
  chemically synthesized

SEQ ID NO: 4298 - protein, 42 aa, Artificial Sequence; identical to SEQ ID NO: 239
  chemically synthesized

SEQ ID NO: 4299 - protein, 42 aa, Artificial Sequence
  chemically synthesized
YQVSPFKIPIEELEDRVFVNCNTSIYRASSLSNCRHTSSVED

SEQ ID NO: 4300 - protein, 42 aa, Artificial Sequence; identical to SEQ ID NO: 359
  chemically synthesized

SEQ ID NO: 4301 - protein, 42 aa, Artificial Sequence; identical to SEQ ID NO: 477
  chemically synthesized

SEQ ID NO: 4302 - protein, 42 aa, Artificial Sequence
  chemically synthesized
SQISPFKIPIEELEDRVFVNCNTSIYRASSLSNCRHTSSVED

SEQ ID NO: 4303 - protein, 42 aa, Artificial Sequence
  chemically synthesized
SQPSPFKIPIEELEDRVFVNCNTSIYRASSLSNCRHTSSVED

SEQ ID NO: 4304 - protein, 42 aa, Artificial Sequence
  chemically synthesized
SQFSPFKIPIEELEDRVFVNCNTSIYRASSLSNCRHTSSVED

SEQ ID NO: 4305 - protein, 42 aa, Artificial Sequence; identical to SEQ ID NO: 596
  chemically synthesized

SEQ ID NO: 4306 - protein, 42 aa, Artificial Sequence
  chemically synthesized
SQVYPFKIPIEELEDRVFVNCNTSIYRASSLSNCRHTSSVED

SEQ ID NO: 4307 - protein, 42 aa, Artificial Sequence
  chemically synthesized
SQVSPWKIPIEELEDRVFVNCNTSIYRASSLSNCRHTSSVED

SEQ ID NO: 4308 - protein, 42 aa, Artificial Sequence
  chemically synthesized
SQVSPYKIPIEELEDRVFVNCNTSIYRASSLSNCRHTSSVED

SEQ ID NO: 4309 - protein, 42 aa, Artificial Sequence
  chemically synthesized
SQVSPHKIPIEELEDRVFVNCNTSIYRASSLSNCRHTSSVED

SEQ ID NO: 4310 - protein, 42 aa, Artificial Sequence
  chemically synthesized
SQVSPFRIPIEELEDRVFVNCNTSIYRASSLSNCRHTSSVED

SEQ ID NO: 4311 - protein, 42 aa, Artificial Sequence
  chemically synthesized
SQVSPFHIPIEELEDRVFVNCNTSIYRASSLSNCRHTSSVED

SEQ ID NO: 4312 - protein, 42 aa, Artificial Sequence
  chemically synthesized
  misc_feature (7)..(7): Xaa can be a proteinogenic, non-proteinogenic or synthetic amino acid like ornithin or selenocystein
SQVSPFXIPIEELEDRVFVNCNTSIYRASSLSNCRHTSSVED

SEQ ID NO: 4313 - protein, 42 aa, Artificial Sequence; identical to SEQ ID NO: 835
  chemically synthesized

SEQ ID NO: 4314 - protein, 42 aa, Artificial Sequence
  chemically synthesized
SQVSPFKHPIEELEDRVFVNCNTSIYRASSLSNCRHTSSVED

SEQ ID NO: 4315 - protein, 42 aa, Artificial Sequence
  chemically synthesized
SQVSPFKVPIEELEDRVFVNCNTSIYRASSLSNCRHTSSVED

SEQ ID NO: 4316 - protein, 42 aa, Artificial Sequence
  chemically synthesized
SQVSPFKFPIEELEDRVFVNCNTSIYRASSLSNCRHTSSVED

SEQ ID NO: 4317 - protein, 42 aa, Artificial Sequence
  chemically synthesized
SQVSPFKMPIEELEDRVFVNCNTSIYRASSLSNCRHTSSVED

SEQ ID NO: 4318 - protein, 42 aa, Artificial Sequence; identical to SEQ ID NO: 953
  chemically synthesized

SEQ ID NO: 4319 - protein, 42 aa, Artificial Sequence
  chemically synthesized
SQVSPFKIPHEELEDRVFVNCNTSIYRASSLSNCRHTSSVED

SEQ ID NO: 4320 - protein, 42 aa, Artificial Sequence
  chemically synthesized
SQVSPFKIPVEELEDRVFVNCNTSIYRASSLSNCRHTSSVED

SEQ ID NO: 4321 - protein, 42 aa, Artificial Sequence
  chemically synthesized
SQVSPFKIPFEELEDRVFVNCNTSIYRASSLSNCRHTSSVED

SEQ ID NO: 4322 - protein, 42 aa, Artificial Sequence
  chemically synthesized
SQVSPFKIPMEELEDRVFVNCNTSIYRASSLSNCRHTSSVED

SEQ ID NO: 4323 - protein, 42 aa, Artificial Sequence; identical to SEQ ID NO: 1073
  chemically synthesized

SEQ ID NO: 4324 - protein, 42 aa, Artificial Sequence
  chemically synthesized
  misc_feature (11)..(11): Xaa can be a proteinogenic, non-proteinogenic or synthetic amino acid like ornithin or selenocystein
SQVSPFKIPIXELEDRVFVNCNTSIYRASSLSNCRHTSSVED

SEQ ID NO: 4325 - protein, 42 aa, Artificial Sequence; identical to SEQ ID NO: 1193
  chemically synthesized

SEQ ID NO: 4326 - protein, 42 aa, Artificial Sequence
  chemically synthesized
  misc_feature (12)..(12): Xaa can be a proteinogenic, non-proteinogenic or synthetic amino acid like ornithin or selenocystein
SQVSPFKIPIEXLEDRVFVNCNTSIYRASSLSNCRHTSSVED

SEQ ID NO: 4327 - protein, 42 aa, Artificial Sequence
  chemically synthesized
SQVSPFKIPIEEVEDRVFVNCNTSIYRASSLSNCRHTSSVED

SEQ ID NO: 4328 - protein, 42 aa, Artificial Sequence; identical to SEQ ID NO: 1310
  chemically synthesized

SEQ ID NO: 4329 - protein, 42 aa, Artificial Sequence
  chemically synthesized
SQVSPFKIPIEEFEDRVFVNCNTSIYRASSLSNCRHTSSVED

SEQ ID NO: 4330 - protein, 42 aa, Artificial Sequence
  chemically synthesized
SQVSPFKIPIEEHEDRVFVNCNTSIYRASSLSNCRHTSSVED

SEQ ID NO: 4331 - protein, 42 aa, Artificial Sequence
  chemically synthesized
SQVSPFKIPIEEMEDRVFVNCNTSIYRASSLSNCRHTSSVED

SEQ ID NO: 4332 - protein, 42 aa, Artificial Sequence; identical to SEQ ID NO: 1430
  chemically synthesized

SEQ ID NO: 4333 - protein, 42 aa, Artificial Sequence
  chemically synthesized
  misc_feature (14)..(14): Xaa can be a proteinogenic, non-proteinogenic or synthetic amino acid like ornithin or selenocystein
SQVSPFKIPIEELXDRVFVNCNTSIYRASSLSNCRHTSSVED

SEQ ID NO: 4334 - protein, 42 aa, Artificial Sequence
  chemically synthesized
  misc_feature (15)..(15): Xaa can be a proteinogenic, non-proteinogenic or synthetic amino acid like ornithin or selenocystein
SQVSPFKIPIEELEXRVFVNCNTSIYRASSLSNCRHTSSVED

SEQ ID NO: 4335 - protein, 42 aa, Artificial Sequence; identical to SEQ ID NO: 120
  chemically synthesized

SEQ ID NO: 4336 - protein, 42 aa, Artificial Sequence; identical to SEQ ID NO: 1549
  chemically synthesized

SEQ ID NO: 4337 - protein, 42 aa, Artificial Sequence
  chemically synthesized
SQVSPFKIPIEELEDHVFVNCNTSIYRASSLSNCRHTSSVED

SEQ ID NO: 4338 - protein, 42 aa, Artificial Sequence
  chemically synthesized
  misc_feature (16)..(16): Xaa can be a proteinogenic, non-proteinogenic or synthetic amino acid like ornithin or selenocystein
SQVSPFKIPIEELEDXVFVNCNTSIYRASSLSNCRHTSSVED

SEQ ID NO: 4339 - protein, 42 aa, Artificial Sequence; identical to SEQ ID NO: 1666
  chemically synthesized

SEQ ID NO: 4340 - protein, 42 aa, Artificial Sequence
  chemically synthesized
SQVSPFKIPIEELEDRLFVNCNTSIYRASSLSNCRHTSSVED

SEQ ID NO: 4341 - protein, 42 aa, Artificial Sequence
  chemically synthesized
SQVSPFKIPIEELEDRFFVNCNTSIYRASSLSNCRHTSSVED

SEQ ID NO: 4342 - protein, 42 aa, Artificial Sequence
  chemically synthesized
SQVSPFKIPIEELEDRHFVNCNTSIYRASSLSNCRHTSSVED

SEQ ID NO: 4343 - protein, 42 aa, Artificial Sequence
  chemically synthesized
SQVSPFKIPIEELEDRMFVNCNTSIYRASSLSNCRHTSSVED

SEQ ID NO: 4344 - protein, 42 aa, Artificial Sequence; identical to SEQ ID NO: 1783
  chemically synthesized

SEQ ID NO: 4345 - protein, 42 aa, Artificial Sequence
  chemically synthesized
SQVSPFKIPIEELEDRVLVNCNTSIYRASSLSNCRHTSSVED

SEQ ID NO: 4346 - protein, 42 aa, Artificial Sequence
  chemically synthesized
SQVSPFKIPIEELEDRVVVNCNTSIYRASSLSNCRHTSSVED

SEQ ID NO: 4347 - protein, 42 aa, Artificial Sequence
  chemically synthesized
SQVSPFKIPIEELEDRVHVNCNTSIYRASSLSNCRHTSSVED

SEQ ID NO: 4348 - protein, 42 aa, Artificial Sequence
  chemically synthesized
SQVSPFKIPIEELEDRVMVNCNTSIYRASSLSNCRHTSSVED

SEQ ID NO: 4349 - protein, 42 aa, Artificial Sequence; identical to SEQ ID NO: 1900
  chemically synthesized

SEQ ID NO: 4350 - protein, 42 aa, Artificial Sequence
  chemically synthesized
SQVSPFKIPIEELEDRVFLNCNTSIYRASSLSNCRHTSSVED

SEQ ID NO: 4351 - protein, 42 aa, Artificial Sequence
  chemically synthesized
SQVSPFKIPIEELEDRVFFNCNTSIYRASSLSNCRHTSSVED

SEQ ID NO: 4352 - protein, 42 aa, Artificial Sequence
  chemically synthesized
SQVSPFKIPIEELEDRVFHNCNTSIYRASSLSNCRHTSSVED

SEQ ID NO: 4353 - protein, 42 aa, Artificial Sequence
  chemically synthesized
SQVSPFKIPIEELEDRVFMNCNTSIYRASSLSNCRHTSSVED

SEQ ID NO: 4354 - protein, 42 aa, Artificial Sequence; identical to SEQ ID NO: 2021
  chemically synthesized

SEQ ID NO: 4355 - protein, 42 aa, Artificial Sequence
  chemically synthesized
SQVSPFKIPIEELEDRVFVNSNTSIYRASSLSNCRHTSSVED

SEQ ID NO: 4356 - protein, 42 aa, Artificial Sequence
  chemically synthesized
SQVSPFKIPIEELEDRVFVNGNTSIYRASSLSNCRHTSSVED

SEQ ID NO: 4357 - protein, 42 aa, Artificial Sequence
  chemically synthesized
SQVSPFKIPIEELEDRVFVNANTSIYRASSLSNCRHTSSVED

SEQ ID NO: 4358 - protein, 42 aa, Artificial Sequence; identical to SEQ ID NO: 2262
  chemically synthesized

SEQ ID NO: 4359 - protein, 42 aa, Artificial Sequence; identical to SEQ ID NO: 2382
  chemically synthesized

SEQ ID NO: 4360 - protein, 42 aa, Artificial Sequence
  chemically synthesized
SQVSPFKIPIEELEDRVFVNCNYSIYRASSLSNCRHTSSVED

SEQ ID NO: 4361 - protein, 42 aa, Artificial Sequence; identical to SEQ ID NO: 2502
  chemically synthesized

SEQ ID NO: 4362 - protein, 42 aa, Artificial Sequence
  chemically synthesized
SQVSPFKIPIEELEDRVFVNCNTYIYRASSLSNCRHTSSVED

SEQ ID NO: 4363 - protein, 42 aa, Artificial Sequence
  chemically synthesized
SQVSPFKIPIEELEDRVFVNCNTSVYRASSLSNCRHTSSVED

SEQ ID NO: 4364 - protein, 42 aa, Artificial Sequence; identical to SEQ ID NO: 2619
  chemically synthesized

SEQ ID NO: 4365 - protein, 42 aa, Artificial Sequence
  chemically synthesized
SQVSPFKIPIEELEDRVFVNCNTSHYRASSLSNCRHTSSVED

SEQ ID NO: 4366 - protein, 42 aa, Artificial Sequence
  chemically synthesized
SQVSPFKIPIEELEDRVFVNCNTSFYRASSLSNCRHTSSVED

SEQ ID NO: 4367 - protein, 42 aa, Artificial Sequence
  chemically synthesized
SQVSPFKIPIEELEDRVFVNCNTSMYRASSLSNCRHTSSVED

SEQ ID NO: 4368 - protein, 42 aa, Artificial Sequence
  chemically synthesized
SQVSPFKIPIEELEDRVFVNCNTSIWRASSLSNCRHTSSVED

SEQ ID NO: 4369 - protein, 42 aa, Artificial Sequence
  chemically synthesized
SQVSPFKIPIEELEDRVFVNCNTSIFRASSLSNCRHTSSVED

SEQ ID NO: 4370 - protein, 42 aa, Artificial Sequence
  chemically synthesized
SQVSPFKIPIEELEDRVFVNCNTSISRASSLSNCRHTSSVED

SEQ ID NO: 4371 - protein, 42 aa, Artificial Sequence; identical to SEQ ID NO: 2737
  chemically synthesized

SEQ ID NO: 4372 - protein, 42 aa, Artificial Sequence
  chemically synthesized
  misc_feature (27)..(27): Xaa can be a proteinogenic, non-proteinogenic or synthetic amino acid like ornithin or selenocystein
SQVSPFKIPIEELEDRVFVNCNTSIYXASSLSNCRHTSSVED

SEQ ID NO: 4373 - protein, 42 aa, Artificial Sequence
  chemically synthesized
SQVSPFKIPIEELEDRVFVNCNTSIYHASSLSNCRHTSSVED

SEQ ID NO: 4374 - protein, 42 aa, Artificial Sequence; identical to SEQ ID NO: 2856
  chemically synthesized

SEQ ID NO: 4375 - protein, 42 aa, Artificial Sequence; identical to SEQ ID NO: 2977
  chemically synthesized

SEQ ID NO: 4376 - protein, 42 aa, Artificial Sequence; identical to SEQ ID NO: 3097
  chemically synthesized

SEQ ID NO: 4377 - protein, 42 aa, Artificial Sequence
  chemically synthesized
SQVSPFKIPIEELEDRVFVNCNTSIYRAYSLSNCRHTSSVED

SEQ ID NO: 4378 - protein, 42 aa, Artificial Sequence; identical to SEQ ID NO: 3217
  chemically synthesized

SEQ ID NO: 4379 - protein, 42 aa, Artificial Sequence
  chemically synthesized
SQVSPFKIPIEELEDRVFVNCNTSIYRASYLSNCRHTSSVED

SEQ ID NO: 4380 - protein, 42 aa, Artificial Sequence; identical to SEQ ID NO: 3334
  chemically synthesized

SEQ ID NO: 4381 - protein, 42 aa, Artificial Sequence
  chemically synthesized
SQVSPFKIPIEELEDRVFVNCNTSIYRASSVSNCRHTSSVED

SEQ ID NO: 4382 - protein, 42 aa, Artificial Sequence
  chemically synthesized
SQVSPFKIPIEELEDRVFVNCNTSIYRASSFSNCRHTSSVED

SEQ ID NO: 4383 - protein, 42 aa, Artificial Sequence
  chemically synthesized
SQVSPFKIPIEELEDRVFVNCNTSIYRASSMSNCRHTSSVED

SEQ ID NO: 4384 - protein, 42 aa, Artificial Sequence
  chemically synthesized
SQVSPFKIPIEELEDRVFVNCNTSIYRASSHSNCRHTSSVED

SEQ ID NO: 4385 - protein, 42 aa, Artificial Sequence; identical to SEQ ID NO: 3454
  chemically synthesized

SEQ ID NO: 4386 - protein, 42 aa, Artificial Sequence
  chemically synthesized
SQVSPFKIPIEELEDRVFVNCNTSIYRASSLYNCRHTSSVED

SEQ ID NO: 4387 - protein, 42 aa, Artificial Sequence; identical to SEQ ID NO: 3575
  chemically synthesized

SEQ ID NO: 4388 - protein, 42 aa, Artificial Sequence
  chemically synthesized
SQVSPFKIPIEELEDRVFVNCNTSIYRASSLSNSRHTSSVED

SEQ ID NO: 4389 - protein, 42 aa, Artificial Sequence
  chemically synthesized
SQVSPFKIPIEELEDRVFVNCNTSIYRASSLSNGRHTSSVED

SEQ ID NO: 4390 - protein, 42 aa, Artificial Sequence
  chemically synthesized
SQVSPFKIPIEELEDRVFVNCNTSIYRASSLSNARHTSSVED

SEQ ID NO: 4391 - protein, 42 aa, Artificial Sequence
  chemically synthesized
  misc_feature (35)..(35): Xaa can be a proteinogenic, non-proteinogenic or synthetic amino acid like ornithin or selenocystein
SQVSPFKIPIEELEDRVFVNCNTSIYRASSLSNCXHTSSVED

SEQ ID NO: 4392 - protein, 42 aa, Artificial Sequence
  chemically synthesized
SQVSPFKIPIEELEDRVFVNCNTSIYRASSLSNCHHTSSVED

SEQ ID NO: 4393 - protein, 42 aa, Artificial Sequence; identical to SEQ ID NO: 3694
  chemically synthesized

SEQ ID NO: 4394 - protein, 42 aa, Artificial Sequence
  chemically synthesized
SQVSPFKIPIEELEDRVFVNCNTSIYRASSLSNCRGTSSVED

SEQ ID NO: 4395 - protein, 42 aa, Artificial Sequence
  chemically synthesized
SQVSPFKIPIEELEDRVFVNCNTSIYRASSLSNCRATSSVED

SEQ ID NO: 4396 - protein, 42 aa, Artificial Sequence
  chemically synthesized
SQVSPFKIPIEELEDRVFVNCNTSIYRASSLSNCRITSSVED

SEQ ID NO: 4397 - protein, 42 aa, Artificial Sequence
  chemically synthesized
SQVSPFKIPIEELEDRVFVNCNTSIYRASSLSNCRLTSSVED

SEQ ID NO: 4398 - protein, 42 aa, Artificial Sequence
  chemically synthesized
SQVSPFKIPIEELEDRVFVNCNTSIYRASSLSNCRMTSSVED

SEQ ID NO: 4399 - protein, 42 aa, Artificial Sequence
  chemically synthesized
SQVSPFKIPIEELEDRVFVNCNTSIYRASSLSNCRVTSSVED

SEQ ID NO: 4400 - protein, 42 aa, Artificial Sequence; identical to SEQ ID NO: 3814
  chemically synthesized

SEQ ID NO: 4401 - protein, 42 aa, Artificial Sequence
  chemically synthesized
SQVSPFKIPIEELEDRVFVNCNTSIYRASSLSNCRHYSSVED

SEQ ID NO: 4402 - protein, 42 aa, Artificial Sequence; identical to SEQ ID NO: 3934
  chemically synthesized

SEQ ID NO: 4403 - protein, 42 aa, Artificial Sequence
  chemically synthesized
SQVSPFKIPIEELEDRVFVNCNTSIYRASSLSNCRHTYSVED

SEQ ID NO: 4404 - protein, 42 aa, Artificial Sequence; identical to SEQ ID NO: 4054
  chemically synthesized

SEQ ID NO: 4405 - protein, 42 aa, Artificial Sequence
  chemically synthesized
SQVSPFKIPIEELEDRVFVNCNTSIYRASSLSNCRHTSYVED

SEQ ID NO: 4406 - protein, 42 aa, Artificial Sequence; identical to SEQ ID NO: 4171
  chemically synthesized

SEQ ID NO: 4407 - protein, 42 aa, Artificial Sequence
  chemically synthesized
SQVSPFKIPIEELEDRVFVNCNTSIYRASSLSNCRHTSSLED

SEQ ID NO: 4408 - protein, 42 aa, Artificial Sequence
  chemically synthesized
SQVSPFKIPIEELEDRVFVNCNTSIYRASSLSNCRHTSSFED

SEQ ID NO: 4409 - protein, 42 aa, Artificial Sequence
  chemically synthesized
SQVSPFKIPIEELEDRVFVNCNTSIYRASSLSNCRHTSSHED

SEQ ID NO: 4410 - protein, 42 aa, Artificial Sequence
  chemically synthesized
SQVSPFKIPIEELEDRVFVNCNTSIYRASSLSNCRHTSSMED

SEQ ID NO: 4411 - protein, 42 aa, Artificial Sequence; identical to SEQ ID NO: 4291
  chemically synthesized

SEQ ID NO: 4412 - protein, 42 aa, Artificial Sequence
  chemically synthesized
  misc_feature (41)..(41): Xaa can be a proteinogenic, non-proteinogenic or synthetic amino acid like ornithin or selenocystein
SQVSPFKIPIEELEDRVFVNCNTSIYRASSLSNCRHTSSVXD

SEQ ID NO: 4413 - protein, 42 aa, Artificial Sequence
  chemically synthesized
SQVSAFKIPIEELEDRVFVNCNTSIYRASSLSNCRHTSSVED

SEQ ID NO: 4414 - protein, 42 aa, Artificial Sequence
  chemically synthesized
SQVSGFKIPIEELEDRVFVNCNTSIYRASSLSNCRHTSSVED

SEQ ID NO: 4415 - protein, 42 aa, Artificial Sequence
  chemically synthesized
SQVSPFKIAIEELEDRVFVNCNTSIYRASSLSNCRHTSSVED

SEQ ID NO: 4416 - protein, 42 aa, Artificial Sequence
  chemically synthesized
SQVSPFKIGIEELEDRVFVNCNTSIYRASSLSNCRHTSSVED

SEQ ID NO: 4417 - protein, 42 aa, Homo sapiens
GQVSPFKIPIEELEDRVFVNCNTSIYRASSLSNCRHTSSVEE

SEQ ID NO: 4418 - protein, 41 aa, Homo sapiens
QVSPFKIPIEELEDRVFVNCNTSIYRASSLSNCRHTSSVEE

SEQ ID NO: 4419 - protein, 40 aa, Homo sapiens
VSPFKIPIEELEDRVFVNCNTSIYRASSLSNCRHTSSVEE

SEQ ID NO: 4420 - protein, 39 aa, Homo sapiens
SPFKIPIEELEDRVFVNCNTSIYRASSLSNCRHTSSVEE

SEQ ID NO: 4421 - protein, 38 aa, Homo sapiens
PFKIPIEELEDRVFVNCNTSIYRASSLSNCRHTSSVEE

SEQ ID NO: 4422 - protein, 37 aa, Homo sapiens
FKIPIEELEDRVFVNCNTSIYRASSLSNCRHTSSVEE

SEQ ID NO: 4423 - protein, 36 aa, Homo sapiens
KIPIEELEDRVFVNCNTSIYRASSLSNCRHTSSVEE

SEQ ID NO: 4424 - protein, 35 aa, Homo sapiens
IPIEELEDRVFVNCNTSIYRASSLSNCRHTSSVEE

SEQ ID NO: 4425 - protein, 34 aa, Homo sapiens
PIEELEDRVFVNCNTSIYRASSLSNCRHTSSVEE

SEQ ID NO: 4426 - protein, 33 aa, Homo sapiens
IEELEDRVFVNCNTSIYRASSLSNCRHTSSVEE

SEQ ID NO: 4427 - protein, 32 aa, Homo sapiens
EELEDRVFVNCNTSIYRASSLSNCRHTSSVEE

SEQ ID NO: 4428 - protein, 41 aa, Homo sapiens
GQVSPFKIPIEELEDRVFVNCNTSIYRASSLSNCRHTSSVE

SEQ ID NO: 4429 - protein, 40 aa, Homo sapiens
GQVSPFKIPIEELEDRVFVNCNTSIYRASSLSNCRHTSSV

SEQ ID NO: 4430 - protein, 39 aa, Homo sapiens
GQVSPFKIPIEELEDRVFVNCNTSIYRASSLSNCRHTSS

SEQ ID NO: 4431 - protein, 38 aa, Homo sapiens
GQVSPFKIPIEELEDRVFVNCNTSIYRASSLSNCRHTS

SEQ ID NO: 4432 - protein, 37 aa, Homo sapiens
GQVSPFKIPIEELEDRVFVNCNTSIYRASSLSNCRHT

SEQ ID NO: 4433 - protein, 36 aa, Homo sapiens
GQVSPFKIPIEELEDRVFVNCNTSIYRASSLSNCRH

SEQ ID NO: 4434 - protein, 35 aa, Homo sapiens
GQVSPFKIPIEELEDRVFVNCNTSIYRASSLSNCR

SEQ ID NO: 4435 - protein, 34 aa, Homo sapiens
GQVSPFKIPIEELEDRVFVNCNTSIYRASSLSNC

SEQ ID NO: 4436 - protein, 33 aa, Homo sapiens
GQVSPFKIPIEELEDRVFVNCNTSIYRASSLSN

SEQ ID NO: 4437 - protein, 32 aa, Homo sapiens
GQVSPFKIPIEELEDRVFVNCNTSIYRASSLS

SEQ ID NO: 4438 - protein, 42 aa, Artificial Sequence
  chemically synthesized
  MISC_FEATURE: synthetic
SESVNISTNVNRFHTFPYCEIAEVSCRSKVRIELDLQSPESS

SEQ ID NO: 4439 - DNA, 30 bp, Homo sapiens
ttcaagatacctatagaggaacttgaggac

SEQ ID NO: 4440 - DNA, 29 bp, Homo sapiens
tagacctggtcattcctcaacagagcttg

SEQ ID NO: 4441 - protein, 58 aa, Artificial Sequence
  chemically synthesized
MEHSTFLSGLVLATLLSQVSPFKIPIEELEDRVFVNCNTSIYRASSLSNCRHTSSVEE

What is claimed is:

1. A synthetic peptide comprising the amino acid sequence of SEQ ID NO:4, the peptide blocks or reduces internalization of the T cell receptor.

2. A synthetic peptide consisting of the amino acid sequence of SEQ ID NO:1.

3. The synthetic peptide according to claim 1, wherein the peptide does not encode exon 3 of CD3 gene complex.

4. The synthetic peptide according to claim 1, wherein peptide is the amino acid sequence of SEQ ID NO:4.

5. A composition comprising the synthetic peptide according to the amino acid sequence of SEQ ID NO:4; and a pharmaceutically acceptable carrier, wherein the peptide blocks or reduces internalization of the T cell receptor.

* * * * *